United States Patent 11,723,967 (ZIKA VIRUS VACCINE) - sequence listing, part 4

SEQ ID NO: 4421 - RNA, 2356 nt, Artificial Sequence
  ZIKV prME variant mRNA Design 1 opt
gggagaaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4422 - RNA, 2353 nt, Artificial Sequence
  ZIKV prME variant mRNA Design 1 opt
gggagaaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4423 - RNA, 2350 nt, Artificial Sequence
  ZIKV prME variant mRNA Design 1 opt
gggagaaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4424 - RNA, 2347 nt, Artificial Sequence
  ZIKV prME variant mRNA Design 1 opt
gggagaaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4425 - RNA, 2344 nt, Artificial Sequence
  ZIKV prME variant mRNA Design 1 opt
gggagaaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4426 - RNA, 2341 nt, Artificial Sequence
  ZIKV prME variant mRNA Design 1 opt
gggagaaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4427 - RNA, 2338 nt, Artificial Sequence
  ZIKV prME variant mRNA Design 1 opt
gggagaaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4428 - RNA, 2335 nt, Artificial Sequence
  ZIKV prME variant mRNA Design 1 opt
gggagaaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4429 - RNA, 2332 nt, Artificial Sequence
  ZIKV prME variant mRNA Design 1 opt
gggagaaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacguggggugcuccgucgauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4430 - RNA, 2329 nt, Artificial Sequence
  ZIKV prME variant mRNA Design 1 opt
gggagaaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4431 - RNA, 2326 nt, Artificial Sequence
  ZIKV prME variant mRNA Design 1 opt
gggagaaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4432 - RNA, 2323 nt, Artificial Sequence
  ZIKV prME variant mRNA Design 1 opt
gggagaaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4433 - RNA, 2320 nt, Artificial Sequence
  ZIKV prME variant mRNA Design 1 opt
gggagaaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacgugggcugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4434 - RNA, 2317 nt, Artificial Sequence
  ZIKV prME variant mRNA Design 1 opt
gggagaaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacgugggcugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4435 - RNA, 2314 nt, Artificial Sequence
  ZIKV prME variant mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgaugugggcugcuccgucgacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4436 - RNA, 2314 nt, Artificial Sequence
  ZIKV prME variant mRNA Design 1 opt
gggagaaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugaugugggcugcuccgucgacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4437 - RNA, 2326 nt, Artificial Sequence
  ZIKV prME variant mRNA Design 1 opt
gggagaaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4438 - RNA, 2350 nt, Artificial Sequence
  ZIKV prME variant mRNA Design 1 opt
gggagaaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacgugggcugcucugucgauuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4439 - RNA, 2350 nt, Artificial Sequence
  ZIKV prME variant mRNA Design 1 opt
gggagaaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacguggggugcucugucgauuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4440 - RNA, 2341 nt, Artificial Sequence
  ZIKV prME variant mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4441 - RNA, 2338 nt, Artificial Sequence
  ZIKV prME variant mRNA Design 1 opt
gggagaaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4442 - RNA, 2335 nt, Artificial Sequence
  ZIKV prME variant mRNA Design 1 opt
gggagaaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4443 - RNA, 2332 nt, Artificial Sequence
  ZIKV prME variant mRNA Design 1 opt
gggagaaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4444 - RNA, 2329 nt, Artificial Sequence
  ZIKV prME variant mRNA Design 1 opt
gggagaaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4445 - RNA, 2326 nt, Artificial Sequence
  ZIKV prME variant mRNA Design 1 opt
gggagaaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4446 - RNA, 2323 nt, Artificial Sequence
  ZIKV prME variant mRNA Design 1 opt
gggagaaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4447 - RNA, 2320 nt, Artificial Sequence
  ZIKV prME variant mRNA Design 1 opt
gggagaaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4448 - RNA, 2317 nt, Artificial Sequence
  ZIKV prME variant mRNA Design 1 opt
gggagaaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4449 - RNA, 2314 nt, Artificial Sequence
  ZIKV prME variant mRNA Design 1 opt
gggagaaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4450 - RNA, 2311 nt, Artificial Sequence
  ZIKV prME variant mRNA Design 1 opt
gggagaaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4451 - RNA, 2308 nt, Artificial Sequence
  ZIKV prME variant mRNA Design 1 opt
gggagaaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4452 - RNA, 2305 nt, Artificial Sequence
  ZIKV prME variant mRNA Design 1 opt
gggagaaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4453 - RNA, 2302 nt, Artificial Sequence
  ZIKV prME variant mRNA Design 1 opt
gggagaaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4454 - RNA, 2299 nt, Artificial Sequence
  ZIKV prME variant mRNA Design 1 opt
gggagaaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4455 - RNA, 2296 nt, Artificial Sequence
  ZIKV prME variant mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgaugugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4456 - RNA, 2296 nt, Artificial Sequence
  ZIKV prME variant mRNA Design 1 opt
gggagaaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugaugugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4457 - RNA, 2308 nt, Artificial Sequence
  ZIKV prME variant mRNA Design 1 opt
gggagaaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4458 - RNA, 2332 nt, Artificial Sequence
  ZIKV prME variant mRNA Design 1 opt
gggagaaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4459 - RNA, 2332 nt, Artificial Sequence
  ZIKV prME variant mRNA Design 1 opt
gggagaaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4460 - RNA, 2332 nt, Artificial Sequence
  ZIKV prME variant mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4461 - RNA, 2329 nt, Artificial Sequence
  ZIKV prME variant mRNA Design 1 opt
gggagaaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4462 - RNA, 2326 nt, Artificial Sequence
  ZIKV prME variant mRNA Design 1 opt
gggagaaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4463 - RNA, 2323 nt, Artificial Sequence
  ZIKV prME variant mRNA Design 1 opt
gggagaaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4464 - RNA, 2320 nt, Artificial Sequence
  ZIKV prME variant mRNA Design 1 opt
gggagaaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4465 - RNA, 2317 nt, Artificial Sequence
  ZIKV prME variant mRNA Design 1 opt
gggagaaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4466 - RNA, 2314 nt, Artificial Sequence
  ZIKV prME variant mRNA Design 1 opt
gggagaaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4467 - RNA, 2311 nt, Artificial Sequence
  ZIKV prME variant mRNA Design 1 opt
gggagaaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4468 - RNA, 2308 nt, Artificial Sequence
  ZIKV prME variant mRNA Design 1 opt
gggagaaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4469 - RNA, 2305 nt, Artificial Sequence
  ZIKV prME variant mRNA Design 1 opt
gggagaaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4470 - RNA, 2302 nt, Artificial Sequence
  ZIKV prME variant mRNA Design 1 opt
gggagaaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4471 - RNA, 2299 nt, Artificial Sequence
  ZIKV prME variant mRNA Design 1 opt
gggagaaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4472 - RNA, 2296 nt, Artificial Sequence
  ZIKV prME variant mRNA Design 1 opt
gggagaaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4473 - RNA, 2293 nt, Artificial Sequence
  ZIKV prME variant mRNA Design 1 opt
gggagaaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4474 - RNA, 2290 nt, Artificial Sequence
  ZIKV prME variant mRNA Design 1 opt
gggagaaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4475 - RNA, 2287 nt, Artificial Sequence
  ZIKV prME variant mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4476 - RNA, 2287 nt, Artificial Sequence
  ZIKV prME variant mRNA Design 1 opt
gggagaaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4477 - RNA, 2299 nt, Artificial Sequence
  ZIKV prME variant mRNA Design 1 opt
gggagaaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4478 - RNA, 2323 nt, Artificial Sequence
  ZIKV prME variant mRNA Design 1 opt
gggagaaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4479 - RNA, 2323 nt, Artificial Sequence
  ZIKV prME variant mRNA Design 1 opt
gggagaaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4480 - RNA, 2329 nt, Artificial Sequence
  ZIKV prME variant mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4481 - RNA, 2323 nt, Artificial Sequence
  ZIKV prME variant mRNA Design 1 opt
gggagaaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4482 - RNA, 2326 nt, Artificial Sequence
  ZIKV prME variant mRNA Design 1 opt
gggagaaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4483 - RNA, 2320 nt, Artificial Sequence
  ZIKV prME variant mRNA Design 1 opt
gggagaaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4484 - RNA, 2317 nt, Artificial Sequence
  ZIKV prME variant mRNA Design 1 opt
gggagaaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4485 - RNA, 2314 nt, Artificial Sequence
  ZIKV prME variant mRNA Design 1 opt
gggagaaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4486 - RNA, 2311 nt, Artificial Sequence
  ZIKV prME variant mRNA Design 1 opt
gggagaaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4487 - RNA, 2308 nt, Artificial Sequence
  ZIKV prME variant mRNA Design 1 opt
gggagaaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4488 - RNA, 2305 nt, Artificial Sequence
  ZIKV prME variant mRNA Design 1 opt
gggagaaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4489 - RNA, 2302 nt, Artificial Sequence
  ZIKV prME variant mRNA Design 1 opt
gggagaaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4490 - RNA, 2299 nt, Artificial Sequence
  ZIKV prME variant mRNA Design 1 opt
gggagaaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4491 - RNA, 2296 nt, Artificial Sequence
  ZIKV prME variant mRNA Design 1 opt
gggagaaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4492 - RNA, 2293 nt, Artificial Sequence
  ZIKV prME variant mRNA Design 1 opt
gggagaaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4493 - RNA, 2290 nt, Artificial Sequence
  ZIKV prME variant mRNA Design 1 opt
gggagaaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4494 - RNA, 2287 nt, Artificial Sequence
  ZIKV prME variant mRNA Design 1 opt
gggagaaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4495 - RNA, 2284 nt, Artificial Sequence; identical to SEQ ID NO: 4401
  ZIKV (strain ZikaSPH2015) Polyprotein(108-794) mRNA Design 1 opt

SEQ ID NO: 4496 - RNA, 2284 nt, Artificial Sequence
  ZIKV prME variant mRNA Design 1 opt
gggagaaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4497 - RNA, 2296 nt, Artificial Sequence
  ZIKV prME variant mRNA Design 1 opt
gggagaaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4498 - RNA, 2320 nt, Artificial Sequence
  ZIKV prME variant mRNA Design 1 opt
gggagaaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4499 - RNA, 2320 nt, Artificial Sequence
  ZIKV prME variant mRNA Design 1 opt
gggagaaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4500 - RNA, 2359 nt, Artificial Sequence; identical to SEQ ID NO: 4397
  KU321639.1 prME-long mRNA Design 1 opt

SEQ ID NO: 4501 - RNA, 2359 nt, Artificial Sequence; identical to SEQ ID NO: 4398
  KU312312.1 prME-long mRNA Design 1 opt

SEQ ID NO: 4502 - RNA, 2347 nt, Artificial Sequence; identical to SEQ ID NO: 4399
  AY632535.2 prME-long mRNA Design 1 opt

SEQ ID NO: 4503 - RNA, 2359 nt, Artificial Sequence; identical to SEQ ID NO: 4400
  KU527068.1 prME-long mRNA Design 1 opt

SEQ ID NO: 4504 - RNA, 2359 nt, Artificial Sequence
  KU720415.1 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucgugaaugauacgggauacgaaacagacgagaacagagcuaaggucgaggugaccccuaauagcccgcgcgcggaagccacccuuggcggcuucgggucccugggacucgauugugagccccggacaggccuggacuuuucugaucuuuauuaccugaccaugaacaauaaacacuggcucguccauaaggaaugguuccacgacauuccucugcccuggcacgcuggggccgauacaggaacgccucauuggaacaauaaagaggcccugguggaauuuaaggacgcucacgccaagagacagaccguugugguccucggcagccaggagggggcggugcauacagcucuggccggcgcccuugaggcugaaauggauggagccaaaggcaagcuguucuccgggcaccucaaaugccgccugaagauggacaaacuucggcugaagggaguuagcuauucucucuguaccgcugccuuuacauucaccaaggugcccgcggagacgcugcauggcaccgucacaguggaagugcaguacgccgggaccgacggaccgugcaaaaucccuguucaaauggcugucgauaugcagacacugacccccgugggcagacucaucacggccaacccugugauuacagaguccaccgaaaacagcaagaugaugcuggagcuugacccucccuuuggggauucuuacaucgucauuggcgugggagacaaaaagaucacacaccacuggcaucgcuccggcagcaccauugggaaggcuuucgaggccaccguucggggagcgaaaagaauggccgugcugggcgauacagcuugggacuucggguccgucggaggcguguuuaauucucucgggaagggcauccaccagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4505 - RNA, 2341 nt, Artificial Sequence
  DQ859059.1 prME-long mRNA Design 1 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucacgcuggucgccguggcuaucgccuggcuccuggggagcucuacaucccagaagguuauuuaccuugugaugauccugcucauugcuccugccuauagcauccggugcauuggagucucuaaucgcgauuuuguggagggcauguccgggggaaccuggguggacgucguucuggaacacggcgggugugugacagugauggcgcaggauaaacccaccgucgacaucgagcuugugaccacaacgguuagcaacauggccgaggugagaucuuacugcuacgaagccuccaucagcgauauggcuuccgacucucgguguccuacccaaggagaggcuuaucuggacaagcagagcgauacacaguacgucugcaaaagaacccucguggaccgcggcuggggcaauggguguggacuguucggcaaggggucccugguuacaugcgccaaguuuaccugcagcaaaaagaugacgggaaaaucuauucagcccgaaaaccucgaguaucggaucaugcuguccgugcacggcagccaacauucugggaugauugucaaugaugaaaacagagccaagguggaggucacaccuaauagcccgcgcgcugaggcgacccuuggaggcuucggcucccuggggcucgacugugaaccccggaccggacuggauuuuucugaccuuuacuaucugacaaugaacaauaaacacuggcucgugcauaaggagugguuccacgauaucccucugcccuggcacgccggcgcugacaccgggacaccucauuggaacaauaaagaagcccugguugaguuuaaggaugcccacgcuaagagacagacgguggucgugcucggaagccaggaaggcgccguucauaccgcgcuggcuggggcccuugaggccgagauggacggcgcuaaaggacgccuguucuccggccaccucaagugccggcugaaaauggauaaacuuagacugaagggggugagcuacucucucuguacagccgcuuuuaccuucacaaagguccccgccgaaacccugcauggaacggugaccguggagguucaguaugcgggcacagacgggccgugcaaggucccugcccaaauggcuguggacaugcagacccugacacccgugggacgccucauuaccgccaacccugucaucacggaauccacagagaacagcaaaaugaugcuggaacuugauccucccuuuggcgacucuuacaucgugauugggguuggcgauaagaaaaucacccaccacuggcaucgguccggaagcacaauuggcaaggcuuucgaggccaccgugagaggggcgaaacgcauggccguccugggagacaccgcuugggauuucggcuccguugggggaguguuuaauucucucggcaaggggauccaccagauuuucggcgccgcuuuuaagagccuguucggaggcauguccugguuuucucaaauccugaucgggacacuucucguguggcugggacugaacacgaaaaauggcagcauuucccucaccugucuggcccuugggggagucaugaucuuccugagcacagccgugucugcugacguuggcugcuccguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4506 - RNA, 2359 nt, Artificial Sequence
  KX377335.1 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccgcaagaaaggcgaagccagacggagccgcagagcggugacccuuccgucccauucuacacggaagcugcaaacccgcagccagacauggcucgaguccagagaguauaccaagcaccugauuaaaguugaaaauuggaucuuucggaaccccggcuucgcccugguggcugucgccauugcuuggcuccuggggagcucuacgucccagaaggugaucuaccuuguuaugauucugcucaucgccccugcguauagcauucgcugcaucggagugucuaauagagauuuugucgagggcauguccgggggaacauggguggacgugguccuggaacauggcggguguguuaccgugauggcccaggauaaacccacaguggacaucgagcuugucaccaccacagugagcaacauggcugagguucggucuuacugcuacgaagccuccauuagcgauauggcuuccgacucuagauguccuacgcaaggagaggccuaucuggacaagcagagcgauacccaguacgugugcaaacgcacacucgucgaccggggcuggggcaauggguguggacuguucggcaaggggucccuggugaccugcgccaaguuuacaugcagcaaaaagaugaccggaaaaucuauccagcccgaaaaccucgaguauagaauuaugcuguccguucacggcagccaacacucugggaugaucgugaaugauacgggauacgaaacagacgagaaccgcgcuaaggucgaggugaccccuaauagcccgcgggcggaagccacccuuggcggcuucgggucccugggacucgauugugagcccagaacaggccuggacuuuucugaucuuuauuaccugaccaugaacaauaaacauuggcucguccacaaggaaugguuccaugacauuccucugcccuggcacgcuggggccgauacaggaacgccucacuggaacaauaaagaggcccugguggaauuuaaggacgcucaugccaagcgccagaccguugugguccucggcagccaggagggggcggugcacacagcucuggccggcgcccuugaggcugaaauggauggagccaaaggcaagcuguucuccgggcaucucaaaugccggcugaagauggacaaacuuagacugaagggaguuagcuauucucucuguaccgcugccuuuacauucaccaaggugcccgcggagacgcugcacggcaccgucacaguggaagugcaguacgccgggaccgacggaccgugcaaaaucccuguucaaauggcugucgauaugcagacacugacccccgugggccgccucaucacggccaacccugugauuacagaguccaccgaaaacagcaagaugaugcuggagcuugacccucccuuuggggauucuuacaucgucauuggcgugggagacaaaaagaucacacaucacuggcaccgguccggcagcaccauugggaaggcuuucgaggccaccguuagaggagcgaaacgcauggccgugcugggcgauacagcuugggacuucggguccgucggaggcguguuuaauucucucgggaagggcauccaucagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4507 - RNA, 2359 nt, Artificial Sequence
  LC002520.1 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugacggugaaugauaucggauacgaaacagacgagaacagagcuaaggucgaggugaccccuaauagcccgcgcgcggaagccacccuuggcggcuucgggucccugggacucgauugugagccccggacaggccuggacuuuucugaucuuuauuaccugaccaugaacaauaaacacuggcucguccauaaggaaugguuccacgacauuccucugcccuggcacgcuggggccgauacaggaacgccucauuggaacaauaaagaggcccugguggaauuuaaggacgcucacgccaagagacagaccguugugguccucggcagccaggagggggcggugcauacagcucuggccggcgcccuugaggcugaaauggauggagccaaaggcaagcuguucuccgggcaccucaaaugccgccugaagauggacaaacuucggcugaagggaguuagcuauucucucuguaccgcugccuuuacauucaccaaggugcccgcggagacgcugcauggcaccgucacaguggaagugcaguacgccgggaccgacggaccgugcaaaaucccuguucaaauggcugucgauaugcagacacugacccccgugggcagacucaucacggccaacccugugauuacagaguccaccgaaaacagcaagaugaugcuggagcuugacccucccuuuggggauucuuacaucgucauuggcgugggagacaaaaagaucacacaccacuggcaucgcuccggcagcaccauugggaaggcuuucgaggccaccguucggggagcgaaaagaauggccgugcugggcgauacagcuugggacuucggguccgucggaggcguguuuaauucucucgggaagggcauccaccagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4508 - RNA, 2347 nt, Artificial Sequence
  KU963573.2 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucggauacgaaacggaugagaauagagcuaagguggaggucacaccuaacagcccgcgcgcggaagccacccuuggcggcuucgggucccugggacucgacugugagccccggaccggccuggauuuuucugaccuuuauuaccugacaaugaauaacaaacacuggcucgugcauaaggaaugguuccacgauauuccucugcccuggcacgcuggggccgacaccggaacaccucauuggaauaacaaagaggcccuggucgaauuuaaggaugcucacgccaagagacagacggugguugugcucggcagccaggagggggcgguccauaccgcucuggccggcgcccuugaggcugaaauggacggagccaaaggcaagcuguucuccgggcaccucaaaugccgccugaagauggauaaacuucggcugaagggagugagcuauucucucuguacagcugccuuuaccuucacaaagguucccgcggagacccugcauggcacggugaccgucgaagugcaguacgccgggacagacggaccgugcaaaaucccugugcaaauggcuguugacaugcagacccugacacccgucggcagacucaucaccgccaauccugugauuacggaguccacagaaaacagcaagaugaugcuggagcuugauccucccuuuggggacucuuacaucgugauuggcgucggagauaaaaagaucacccaccacuggcaucgcuccggcagcacaauugggaaggcuuucgaggccaccgugcggggagcgaaaagaauggccguucugggcgacaccgcuugggauuucggguccgugggaggcgucuuuaacucucucgggaagggcauccaccagaucuucggagccgcuuuuaaaagccuguucggcgggauguccugguuuucucaaauucugaucggaacacuucucguguggcugggccugaauacgaagaacgggagcauuucccucaccugucuggcccuuggaggcguuaugaucuuccugagcacagccgugucugcugacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4509 - RNA, 2359 nt, Artificial Sequence
  KX694534.2 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggcggggcauucaccagaucuucggagcugcguuuaaaagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4510 - RNA, 2359 nt, Artificial Sequence
  KX447520.1 prME-long mRNA Design 1 opt
gggagaaagcuuaccaugagaaucauuaacgcccggaaggagaaaaagcgcagaggcgcugacgccagcguggggaucgucggacugcuccugaccacagcgauggcugccgaaguuacgcggcgcggcuccgccuacuauauguaccuugauagaaaugacgcuggggaggccauuucuuuccccaccacacugggaaugaacaaaugcuauauccagauuauggaucucggccacaugugugacgcuaccaugagcuacgaaugcccuaugcuggaugaggggguggaaccggacgauguggacuguuggugcaauacaaccuccacaugggucguguauggaaccugucaucacaagaaaggcgaggcccggcgcucuagacgggcgguuacgcuucccagccauuccacccgcaagcugcaaacaagaucucagaccuggcucgagagccgggaauacacaaagcaccugauccgcguggagaacuggaucuuuagaaauccuggcuucgcccuggcugccgcugccauugcguggcuccugggguccagcaccucucagaaagucaucuaucuugugaugauucugcucaucgcccccgcuuacuccauucggugcaucggaguuagcaaccgcgauuuuguggaaggcaugucugggggaacgugggucgacguggugcuggagcauggcgggugugucacaguuauggcccaggauaagccuaccguggacauugagcuugugacaaccaccgucuccaauauggcugaagugagaagcuacugcuaugaggccucuaucuccgauauggccagcgacucccggugucccacacaaggagaggcuuaccuggacaaacagucugauacgcaguauguuugcaagagaacccucguggaccgcggcuggggcaacggguguggacuguucggcaaagggagccuggucacaugcgcgaaguuugccugcuccaagaaaaugaccggaaagagcauccagccugaaaaucucgaauaccggauuaugcugucugugcacggcucccaacacagcgggaugaucguuaacgauacaggacaugagaccgacgagaauagagcuaaaguggaaauuacgccgaacucuccccgcgccgaggccacacuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4511 - RNA, 2359 nt, Artificial Sequence
  KX369547.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggccuggcgcucgccgcugccgcuauugccuggcugcuuggguccagcacgucucagaaagucaucuaucuggugaugauucuccugaucgcgcccgccuacuccauucggugcaucggaguuagcaaccgcgauuucguggaaggcaugucugggggaacaugggucgacguggugcuugagcauggcgggugugucaccguuauggcucaggauaagccuacaguggacauugagcuggugaccaccacagucuccaauauggccgaagugagaagcuacugcuaugaggcuucuaucuccgauauggccagcgacucccggugucccacgcaaggagaagccuaccucgacaaacagucugauacccaguauguuugcaagagaacacugguggaccgcggcuggggcaacggguguggacuguuuggcaaagggagccucgugaccugcgcuaaguucgcgugcuccaagaaaaugacaggaaagagcauccagccugagaaucuggaauaccggauuaugcuuucuguccacggcucccaacacagcgggaugaucguuaacgauaccggacaugagacggacgagaauagagccaaaguggaaauuacaccgaacucuccccgcgcugaggccacccugggcggcuuugggagccucggacuggauugugaaccucggaccggccuugacuucuccgaucuguauuaccucacaaugaauaacaagcacuggcugguccauaaagagugguuucacgacaucccccugccuuggcacgccggggcugauaccggaacaccccauuggaauaacaaggaagcccucguggaguucaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuuuaccuucacaaaaauuccggcugaaacccugcauggcacggugaccguugaggugcaguacgccgggacagacggaccuugcaagguccccgcucaaauggccguggauaugcagacccucacaccugugggccgccugaucaccgcgaaccccguuaucacggaauccacagagaauagcaagaugaugcuugagcuggaucccccuuuuggggacucuuacauugucaucggcgugggagagaaaaagauuacccaccacuggcaucgguccggcagcacaaucgggaaagccuucgaagcuaccgugagaggagccaagcgcauggcuguccucggcgacaccgccugggauuuuggguccgugggaggcgcccugaacucucuggggaaaggcauucaccagaucuucggagcugcguucaagagccuuuuuggcgggauguccugguucucucaaauccucauuggaacacugcugauguggcucggccugaauacgaagaacgggagcaucucccuuaugugucuggcccucggaggcguucugauuuuucugagcaccgcugugucugccgacgucgggugcuccguggauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4512 - RNA, 2359 nt, Artificial Sequence
  KX447515.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacugguaucgguccggcagcacaaucgggaaagccuuugaagcuaccgugagaggagccaagcgcauggcuguccugggcgacaccgccugggauuucggguccgugggaggcgcccucaacucucuggggaaaggcauucaucagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4513 - RNA, 2359 nt, Artificial Sequence
  KU501217.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaaaucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4514 - RNA, 2359 nt, Artificial Sequence
  KU312314.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugccccaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccuggcucaaauggccguggauaugcagacccucacacccgugggccgccugaucaccgcgaacccuguuaucacggaauccacagagaauagcaagaugaugcuugagcuggacccucccuucggggauucuuacauugucaucggcgugggagagaaaaagauuacccaccacuggcaucgguccggcagcacaaucgggaaagccuuugaagcuaccgugagaggagccaagcgcauggcuguccucggcgacaccgccugggauuucggguccgugggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcguucugauuuuccugagcaccgcugugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4515 - RNA, 2359 nt, Artificial Sequence
  KX446950.2 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuacccuggaugaggggguggaaccggacgauguggacuguuggugcaauacaaccuccacgugggucguguauggaaccugucaucacaagaaaggcgaggcucggcgcucuagacgggccguuacacuucccagccauuccacccgcaagcugcaaacaagaucucagaccuggcucgagagccgggaauacacgaagcaccugauccgcguggagaacuggaucuuuagaaauccuggcuucgcgcuggccgcugccgcuauugccuggcuccugggguccagcacaucucagaaagucaucuaucuugugaugauucugcucaucgcgcccgccuacuccauucggugcaucggaguuagcaaccgcgauuuuguggaaggcaugucugggggaaccugggucgacguggugcuggagcauggcgggugugucacaguuauggcucaggauaagccuaccguggacauugagcuugugaccacaacggucuccaauauggccgaagugagaagcuacugcuaugaggcuucuaucuccgauauggccagcgacucccggugucccacccaaggagaagccuaccuggacaaacagucugauacacaguauguuugcaagagaacccucguggaccgcggcuggggcaacggguguggacuguucggcaaagggagccuggucacaugcgcuaaguuugcgugcuccaagaaaaugaccggaaagagcauccagccugagaaucucgaauaccggauuaugcugucugugcacggcucccaacacagcgggaugaucguuaacgauacgggacaugagacagacgagaauagagccaaaguggaaauuaccccgaacucuccccgcgcugaggccacccuuggcggcuucgggagccugggacucgauugugaaccucggacaggccuggacuuuuccgaucuuuauuaccugaccaugaauaacaagcacuggcucguccauaaagagugguuccacgacaucccccugccuuggcacgccggggcugauacaggaacgccccauuggaauaacaaggaagcccugguggaguuuaaagacgcgcacgcuaagagacagaccgucgugguucucggcucucaggagggggccgugcauacagcccuggcuggcgcccuugaagcugagauggauggagccaagggccgccugagcuccgggcaccucaaaugccggcugaagauggacaaacuuagacugaagggagucagcuauucucucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaauccaccgagaauagcaagaugaugcuggagcuugaucccccuuucggggacucuuacauugucaucggcgugggagagaaaaagauuacacaccacuggcaucgguccggcagcaccaucgggaaagccuuugaagcuaccgugagaggagccaagcgcauggcuguccugggcgacacagccugggauuucggguccgugggaggcgcccucaacucucuggggaaaggcauucaccagaucuucggagcugcguuuaagagccuguucggcgggauguccugguuuucucaaauccuuauuggaacgcuccugauguggcugggccucaauaccaagaacgggagcaucucccugaugugucuugcccugggaggcguucucauuuuccugagcacagcugugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4516 - RNA, 2359 nt, Artificial Sequence
  KY003157.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccguggucucugcugacguggggugcuccguugauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4517 - RNA, 2359 nt, Artificial Sequence
  KX811222.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccgcuugggucguguauggaaccugucaucacaagaaaggcgaggcccggcgcucuagacgggcgguuacgcuucccagccauuccacccgcaagcugcaaacaagaccucagaccuggcucgagucucgggaauacacaaagcaccugauccgcguggagaacuggaucuuuagaaaucccggcuucgcccuggcugccgcugccauugcguggcuccuggggagcuccaccagccagaaagucaucuaucuugugaugauucugcucaucgccccugcuuacucuauucggugcaucggaguuuccaaccgcgauuuuguggaaggcaugagcgggggaacgugggucgacguggugcuggagcauggcgggugugucacaguuauggcccaggauaagcccaccguggacauugagcuugugacaaccaccgucucuaauauggcugaagugagauccuacugcuaugaggccagcaucucugauauggccuccgacagccgguguccuacacaaggagaggcuuaccuggacaaacaguccgauacgcaguauguuugcaagagaacccucguggaccgcggcuggggcaacggguguggacuguucggcaaagggucucuggucacaugcgcgaaguuugccugcagcaagaaaaugaccggaaaguccauccagccggagaaucucgaauaccggauuaugcugagcgugcacggcucucaacacuccgggaugaucguuaacgauacaggacaugagaccgacgagaauagagcuaaaguggaaauuacgcccaacagcccucgcgccgaggccacacuuggcggcuucgggucucugggacucgauugugaaccccggaccggccuggacuuuagcgaucuuuauuaccugaccaugaauaacaagcacuggcucguccauaaagagugguuccacgacaucccucugcccuggcacgcuggggccgauacaggaaccccgcauuggaauaacaaggaagcgcugguggaguuuaaagacgcucacgccaagagacagacagucgugguucucggcucccaggagggggccgugcauacggcucuggccggcgcucuugaagccgagauggauggagcgaagggccgccugucuagcgggcaccucaaaugccggcugaagauggacaaacuuagacugaagggagucuccuauagccucuguaccgccgcuuucacauuuaccaaaauuccugccgaaacacugcauggcaccgugacgguugaggugcaguacgcugggaccgacggacccugcaaggucccugcccaaauggcgguggauaugcagacacugacccccgugggccgccucaucacagccaaccccguuaucaccgaaucuacggaaaauuccaagaugaugcuggagcuugacccuccguucggggauagcuacauugucaucggcgugggagagaaaaagauuacacaccacuggcaucggucuggcuccaccaucgggaaggcuuuugaagccacagugagaggagcuaaacgcauggccguccugggcgacaccgccugggauuucgggagcgugggaggcgcucucaacucccuggggaaaggcauucaccagaucuucggagcggccuuuaagucucuguucggcgggaugagcugguuuucccaaauccuuauuggaacccuccugauguggcugggccucaauacaaagaacgggucuaucagccugaugugucuugcucugggaggcguucucauuuuccuguccacggccgugagcgccgacgucgggugcucuguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4518 - RNA, 2359 nt, Artificial Sequence
  KX447516.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucuaaaaaggucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaaaccuacaguggacauugagcuugugaccaccacagucuccaauauggccgaagugagaagcuacugcuaugaggcuucuaucuccgauauggccagcgacucccggugucccacgcagggagaagccuaccuggacaagcaaucugauacccaguauguuugcaaaagaacacucguggaccgcggcuggggcaacggguguggacuguucggcaaggggagccuggugaccugcgcuaaguuugcgugcuccaaaaagaugacaggaaaaagcauccagccugagaaucucgaauaccggauuaugcugucuguccacggcucccagcacagcgggaugaucguuaacgauaccggacaugagacggacgagaauagagccaagguggaaauuacaccgaacucuccccgcgcugaggccacccuuggcggcuucgggagccugggacucgauugugaaccucggaccggccuggacuuuuccgaucuuuauuaccugacaaugaauaacaaacacuggcucguccauaaggagugguuccacgacaucccccugccuuggcacgccggggcugauaccggaacaccccauuggaauaacaaagaagcccugguggaguuuaaggacgcgcacgcuaagagacaaacggucgugguucucggcucucaggagggggccgugcauaccgcccuggcuggcgcccuugaagcugagauggauggagccaaaggccgccugagcuccgggcaccucaagugccggcugaaaauggacaaacuuagacugaagggagucagcuauucucucuguacagcggccuucaccuuuacaaagauuccggcugaaacccugcauggcacggugaccguugaggugcaguacgccgggacagacggaccuugcaagguccccgcucagauggccguggauaugcaaacccugacaccugugggccgccucaucaccgcgaaccccguuaucacggaauccacagagaauagcaaaaugaugcuggagcuugaucccccuuucggggacucuuacauugucaucggcgugggagaaaagaaaauuacccaccacuggcaucgguccggcagcacaaucgggaaggccuuugaggcuaccgugagaggagccaaacgcauggcuguccugggcgacaccgccugggauuucggguccgugggaggcgcccucaacucucuggggaagggcauucaccagaucuucggagcugcguuuaagagccuguucggcgggauguccugguuuucucagauccuuauuggaacacuccugauguggcugggccucaauacgaaaaacgggagcaucucccugaugugucuugcccugggaggcguucucauuuuccugagcaccgcugugucugccgacgucgggugcuccguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4519 - RNA, 2359 nt, Artificial Sequence
  KX520666.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgcggcagaaagucaucuaucuugugaugauucugcucaucgcgcccgccuacucuauucgcugcaucggaguuuccaacagagauuuuguggaaggcaugagcgggggaacaugggucgacguggugcuggagcauggcgggugugucaccguuauggcucaggauaagccuacaguggacauugagcuugugaccaccacagucucuaauauggccgaagugcgguccuacugcuaugaggcuagcaucucugauauggccuccgacagcagaugucccacgcaaggagaagccuaccuggacaaacaguccgauacccaguauguuugcaagcgcacacucguggaccggggcuggggcaacggguguggacuguucggcaaagggucucuggugaccugcgcuaaguuugcgugcagcaagaaaaugacaggaaaguccauccagccugagaaucucgaauacagaauuaugcugagcguccacggcucucaacacuccgggaugaucguuaacgauaccggacaugagacggacgagaaucgcgccaaaguggaaauuacaccgaacagcccccgggcugaggccacccuuggcggcuucgggucucugggacucgauugugaaccuagaaccggccuggacuuuagcgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagcgccagacggucgugguucucggcucccaggagggggccgugcauaccgcccuggcuggcgcccuugaagcugagauggauggagccaagggccggcugucuagcgggcaccucaaaugcagacugaagauggacaaacuucgccugaagggagucuccuauagccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccggcucaucaccgcgaaccccguuaucacggaaucuacagaaaauuccaagaugaugcuggagcuugaucccccuuucggggacagcuacauugucaucggcgugggagagaaaaagauuacccaccacuggcauagaucuggcuccacaaucgggaaagccuuugaggcuaccgugcgcggagccaagcggauggcuguccugggcgacaccgccugggauuucgggagcgugggaggcgcccucaacucccuggggaaaggcauucaccagaucuucggagcugcguuuaagucucuguucggcgggaugagcugguuuucccaaauccuuauuggaacacuccugauguggcugggccucaauacgaagaacgggucuaucagccugaugugucuugcccugggaggcguucucauuuuccuguccaccgcugugagcgccgacgucgggugcucuguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4520 - RNA, 2359 nt, Artificial Sequence
  KU729218.1 prME-long mRNA Design 1 opt
gggagaaagcuuaccaugagaaucauuaacgcccggaaggagaaaaagcgcagaagcgcugacaccuccgugggcaucgucgggcugcuccugacaacggccauggcggcugaaguuacccggcgcggaucugccuacuauauguaccuugauagaaaugacgccggcgaggcuauuagcuuccccacaacccuggggaugaacaaaugcuauauccagauuauggaucucggacacaugugugacgccacaauguccuacgaaugcccuaugcuggaugagggcguggaaccggacgauguggacuguuggugcaauaccacaucuaccugggucguguaugggacgugucaucacaagaaaggagaggcucggcgcagcagacgggccguuacccuucccucccauucuacacgcaagcugcaaaccagaagccagacauggcucgagucccgggaauacaccaagcaccugauccgcguggagaacuggaucuuuagaaauccuggcuucgcgcuggccgcugccgcuauugccuggcuccugggcagcucuacgucccagaaagucaucuaucuugugaugauucugcucaucgcgcccgccuacagcauucggugcaucgggguuucuaaccgcgauuuuguggaaggaauguccggcgggacaugggucgacguggugcuggagcauggaggcugugucaccguuauggcucaggauaagccuacaguggacauugagcuugugaccaccacagucagcaauauggccgaagugagaucuuacugcuaugaggcuuccaucagcgauauggccuccgacucucggugucccacgcaaggggaagccuaccuggacaaacagagcgauacccaguauguuugcaagagaacacucguggaccgcggauggggcaacggcugugggcuguucggaaaaggcucccuggugaccugcgcuaaguuugcgugcagcaagaaaaugacagggaagucuauccagccugagaaucucgaauaccggauuaugcuguccgugcacggaagccaacacucuggcaugaucguuaacgauaccgggcaugagacggacgagaauagagccaaaguggaaauuacaccgaacagcccccgcgcugaggccacccuuggaggcuucggcucccuggggcucgauugugaaccucggaccggacuggacuuuucugaucuuuauuaccugacaaugaauaacaagcacuggcucguccauaaagagugguuccacgacaucccccugccuuggcacgccggcgcugauaccgggacaccccauuggaauaacaaggaagcccugguggaguuuaaagacgcgcacgcuaagagacagacggucgugguucucggaagccaggagggcgccgugcauaccgcccuggcuggggcccuugaagcugagauggauggcgccaagggacgccuguccagcggccaccucaaaugccggcugaagauggacaaacuuagacugaagggggucucuuauucccucuguacagcggccuucaccuuuacaaaaauuccggcugaaacccugcauggaacggugaccguugaggugcaguacgccggcacagacgggccuugcaagguccccgcucaaauggccguggauacccagacacugaccccugugggacgccucaucacggcgaaccccguuaucacagaaagcaccgaaaauucuaagaugaugcuggagcuugaucccccuuucggcgacuccuacauugucaucggggugggcgagaaaaagauuacacaccacuggcaucggagcggauccaccaucggcaaagccuuugaggcuaccgugagaggggccaagcgcauggcuguccugggagacacagccugggauuucggcucugucgggggagcccucaacagccugggcaaagggauucaccagaucuucggcgcugcguuuaagucccuguucggaggcaugucuugguuuagccaaauccuuauugggacgcuccugauguggcugggacucaauaccaagaacggcuccaucagccugaugugucuugcccucgggggaguucugauuuuccugucuacagcuguguccgccgacgucggcugcagcguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4521 - RNA, 2359 nt, Artificial Sequence
  KU761561.1 prME-long mRNA Design 1 opt
gggagaaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaccacaagcaccugggucguguauggaacgugucaucacaagaaaggcgaggcucggcgcuccagacgggccguuacccuucccucucauagcacacgcaagcugcaaaccagaucccagacauggcucgagucucgggaauacaccaagcaccugauccgcguggagaauuggaucuuuagaaacccuggcuucgcgcuggccgcugccgcuauugccuggcuccuggggagcuccacgagccagaaagucaucuaucuugugaugauucugcucaucgcgcccgccuacucuauucggugcaucggaguuuccaaucgcgauuuuguggaaggcaugagcgggggaacaugggucgacguggugcuggagcauggcgggugugucaccguuauggcucaggauaagccuacaguggacauugagcuugugaccaccacagucucuaacauggccgaagugagauccuacugcuaugaggcuagcaucucugauauggccuccgacagccggugucccacgcaaggagaagccuaccuggacaaacaguccgauacccaguauguuugcaagagaacacucguggaccgcggcuggggcaauggguguggacuguucggcaaagggucucuggugaccugcgcuaaguuugcgugcagcaagaaaaugacaggaaaguccauccagccugagaaccucgaauaccggauuaugcugagcguccacggcucucaacacuccgggaugaucguuaaugauaccggacaugagacggacgagaacagagccaaaguggaaauuacaccgaauagcccccgcgcugaggccacccuuggcggcuucgggucucugggacucgauugugaaccucggaccggccuggacuuuagcgaucuuuauuaccugacaaugaacaauaagcacuggcucguccauaaagagugguuccacgacaucccccugccuuggcacgccggggcugauaccggaacaccccauuggaacaacaaggaagcccugguggaguuuaaagacgcgcacgcuaagagacagacggucgugguucucggcucccaggagggggccgugcauaccgcccuggcuggcgcccuugaagcugagauggauggagccaagggccgccugucuagcgggcaccucaaaugccggcugaagauggacaaacuuagacugaagggagucuccuauagccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaucccguuaucacggaaucuacagagaacuccaagaugaugcuggagcuugaucccccuuucggggacagcuacauugucaucggcgugggagagaaaaagauuacccaccacuggcaucggucuggcuccacaaucgggaaagccuuugaagcuaccgugagaggagcccgccggauggcuguccugggcgacaccgccugggauuucgggagcgugggaggcgcccucaauucccuggggaagggcauucaccagaucuucggagcugcguuuaaaucucuguucggcgggaugagcugguuuucccaaauccuuauuggaacacuccugauguggcugggccucaacacgaagaaugggucuaucagccugaugugucuugcccugggaggcguucucauuuuccuguccaccgcugugagcgccgacgucgggugcucuguggauuuuuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4522 - RNA, 2359 nt, Artificial Sequence
  KY317938.1 prME-long mRNA Design 1 opt
gggagaaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugcccuaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcguggaaaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgacuuuguggagggcaugucugggggaacaugggucgauguggugcuggagcauggcgggugugucaccguuauggcucaggacaagccuacaguggauauugaacuugugaccaccacagucuccaauauggccgaggugagaagcuacugcuaugaggcuucuaucuccgacauggccagcgauucccggugucccacgcaaggagaagccuaccuggacaaacagucugacacccaguauguuugcaagagaacacucguggaucgcggcuggggcaacggguguggacuguucggcaaagggagccuggugaccugcgcuaaguuugcgugcuccaagaaaaugacaggaaagagcauccagccugaaaaucucgaguaccggauuaugcugucuguccacggcucccaacacagcgggaugaucguuaacgacaccggacaugagacggaugaaaauagagccaaaguggagauuacaccgaacucuccccgcgcugaagccacccuuggcggcuucgggagccugggacucgacugugagccucggaccggccuggauuuuuccgaccuuuauuaccugacaaugaauaacaagcacuggcucguccauaaagaaugguuccacgauaucccccugccuuggcacgccggggcugacaccggaacaccccauuggaauaacaaggaggcccugguggaguuuaaagaugcgcacgcuaagagacagacggucgugguucucggcucucaggaaggggccgugcauaccgcccuggcuggcgcccuugaggcugaaauggacggagccaagggccgccugagcuccgggcaccucaaaugccggcugaagauggauaaacuuagacugaagggagucagcuauucucucuguacagcggccuucaccuuuacaaaaauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaauagcaagaugaugcuggaacuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgauaccgccugggacuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgaugucgggugcuccguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4523 - RNA, 2359 nt, Artificial Sequence
  KY075939.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacucccugcggugcauuggaguuagcaaccgcgauuuuguggaaggcaugucugggggaacaugggucgacguggugcuugagcauggcgggugugucaccguuauggcucaggauaagccuacaguggacaucgagcuggugaccaccacagucuccaauauggccgaagugagaagcuacugcuaugaggcuucuauuuccgauauggccagcgacucccggugucccacgcaaggagaagccuaccucgacaaacagucugauacccaguauguuugcaagagaacacugguggaccgcggcuggggcaacggguguggacuguucggcaaagggagccucgugaccugcgcuaaguuugcgugcuccaagaaaaugacaggaaagagcauccagccugagaaucuggaauaccggaucaugcuuucuguccacggcucccaacacagcgggaugauuguuaacgauaccggacaugagacggacgagaauagagccaaaguggaaaucacaccgaacucuccccgcgcugaggccacccugggcggcuucgggagccucggacuggauugugaaccucggaccggccuugacuuuuccgaucuguauuaccucacaaugaauaacaagcacuggcugguccauaaagagugguuccacgacauuccccugccuuggcacgccggggcugauaccggaacaccccauuggaauaacaaggaagcccucguggaguuuaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuucaccuuuacaaaaaucccggcugaaacccugcauggcacggugaccguugaggugcaguacgccgggacagacggaccuugcaagguccccgcucaaauggccguggauaugcagacccucacaccugugggccgccugauuaccgcgaaccccguuaucacggaauccacagagaauagcaagaugaugcuugagcuggaucccccuuucggggacucuuacaucgucauuggcgugggagagaaaaagaucacccaccacuggcaucgguccggcagcacaauugggaaagccuuugaagcuaccgugagaggagccaagcgcauggcuguccucggcgacaccgccugggauuucggguccgugggaggcgcccugaacucucuggggaaaggcauccaccagauuuucggagcugcguuuaagagccuuuucggcgggauguccugguuuucucaaauccucaucggaacacugcugauguggcucggccugaauacgaagaacgggagcauuucccuuaugugucuggcccucggaggcguucugaucuuccugagcaccgcugugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4524 - RNA, 2359 nt, Artificial Sequence
  KX806557.2 prME-long mRNA Design 1 opt
gggagaaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaccacaagcaccugggucguguauggaacgugucaucacaagaaaggcgaggcucggcgcuccagacgggccguuacccuucccucucauagcacacgcaagcugcaaaccagaucccagacauggcucgagucucgggaauacaccaagcaccugauccgcguggagaauuggauguuuagaaacccuggcuucgcgcuggccgcugccgcuaucgccuggcuccuggggagcuccacgagccagaaagucauuuaucuugugaugauccugcucauugcgcccgccuacucuauccggugcauuggaguuuccaaucgcgauuuuguggaaggcaugagcgggggaacaugggucgacguggugcuggagcauggcgggugugucaccguuauggcucaggauaagccuacaguggacaucgagcuugugaccaccacagucucuaacauggccgaagugagauccuacugcuaugaggcuagcauuucugauauggccuccgacagccggugucccacgcaaggagaagccuaccuggacaaacaguccgauacccaguauguuugcaagagaacacucguggaccgcggcuggggcaauggguguggacuguucggcaaagggucucuggugaccugcgcuaaguuugcgugcagcaagaaaaugacaggaaaguccauccagccugagaaccucgaauaccggaucaugcugagcguccacggcucucaacacuccgggaugauuguuaaugauaccggacaugagacggacgagaacagagccaaaguggaaaucacaccgaauagcccccgcgcugaggccacccuuggcggcuucgggucucugggacucgauugugaaccucggaccggccuggacuuuagcgaucuuuauuaccugacaaugaacaauaagcacuggcucguccauaaagagugguuccacgacauuccccugccuuggcacgccggggcugauaccggaacaccccauuggaacaacaaggaagcccugguggaguuuaaagacgcgcacgcuaagagacagacggucgugguucucggcucccaggagggggccgugcauaccgcccuggcuggcgcccuugaagcugagauggauggagccaagggccgccugucuagcgggcaccucaaaugccggcugaagauggacaaacuuagacugaagggagucuccuauagccucuguacagcggccuucaccuuuacaaaaaucccggcugaaacccugcauggcacggugaccguugaggugcaguacgccgggacagacggaccuugcaagguccccgcucaaauggccguggauaugcagacccugacaccugugggccgccucauuaccgcgaaucccguuaucacggaaucuacagagaacuccaagaugaugcuggagcuugaucccccuuucggggacagcuacaucgucauuggcgugggagagaaaaagaucacccaccacuggcaucggucuggcuccacaauugggaaagccuuugaagcuaccgugagaggagccaagcgcauggcuguccugggcgacaccgccugggauuucgggagcgugggaggcgcccucaauucccuggggaaaggcauccaccagauuuucggagcugcguuuaagucucuguucggcgggaugagcugguuuucccaaauccuuaucggaacacuccugauguggcugggccucaacacgaagaaugggucuauuagccugaugugucuugcccugggaggcguucucaucuuccuguccaccgcugugagcgccgacgucgggugcucuguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4525 - RNA, 2359 nt, Artificial Sequence
  KU870645.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggauccugagaaauccuggcuuugcgcucgccgcugccgcuauugccuggcugcuuggguccagcacgucucagaaagucaucuaucuggugaugauucuccugaucgcgcccgccuacuccauucggugcaucggaguuagcaaccgcgauuucguggaaggcaugucugggggaacaugggucgacguggugcuugagcauggcgggugugucaccguuauggcucaggauaagccuacaguggacauugagcuggugaccaccacagucuccaauauggccgaagugagaagcuacugcuaugaggcuucuaucuccgauauggccagcgacucccggugucccacgcaaggagaagccuaccucgacaaacagucugauacccaguauguuugcaagagaacacugguggaccgcggcuggggcaacggguguggacuguuuggcaaagggagccucgugaccugcgcuaaguucgcgugcuccaagaaaaugacaggaaagagcauccagccugagaaucuggaauaccggauuaugcuuucuguccacggcucccaacacagcgggaugaucguuaacgauaccggacaugagacggacgagaauagagccaaaguggaaauuacaccgaacucuccccgcgcugaggccacccugggcggcuuugggagccucggacuggauugugaaccucggaccggccuugacuucuccgaucuguauuaccucacaaugaauaacaagcacuggcugguccauaaagagugguuucacgacaucccccugccuuggcacgccggggcugauaccggaacaccccauuggaauaacaaggaagcccucguggaguucaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuuuaccuucacaaaaauuccggcugaaacccugcauggcacggugaccguugaggugcaguacgccgggacagacggaccuugcaagguccccgcucaaauggccguggauaugcagacccucacaccugugggccgccugaucaccgcgaaccccguuaucacggaauccacagagaauagcaagaugaugcuugagcuggaucccccuuuuggggacucuuacauugucaucggcauuggagagaaaaagaucacccaccacuggcaucgguccggcagcacaauugggaaagccuucgaagcuaccgugagaggagccaagcgcauggcugugcucggcgacaccgccugggauuuuggguccgucggaggcgcccugaacucucuggggaaaggcauccaccagaucuucggagcugcguucaagagccuuuuuggcgggauguccugguucucucaaauucucaucggaacacugcugauguggcucggccugaauacgaagaacgggagcauuucccuuaugugucuggcccucggaggcgugcugaucuuucugagcaccgcuguuucugccgacguggggugcuccgucgauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4526 - RNA, 2359 nt, Artificial Sequence
  KU729217.2 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuuguguccaccaccgucagcaauauggccgaagugagaucuuacugcuaugaggcuacaaucuccgauaucgccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauuguuaacgauaccggacaugagacggacgagaauagagccaaaguggaaaucacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacauuccccugccuuggcacgccggggcugauaccggaacaccccauuggaauaacaaggaagcccugguggaguuuaaagacgcgcacgcuaagagacagacggccgucgugcucggcucucaggagggggccguucauaccgcucuggccggcgcucuugaagccgagauggauggagcgaagggccgccugagcuccgggcaccucaaaugccggcugaagauggacaaacuuagacugaagggagugagcuauucucucuguacagccgcuuucaccuuuacaaaaaucccggccgaaacccugcauggcacggucaccguggagguucaguacgcugggacagacggaccuugcaaggugcccgcccaaauggcggucgauaugcagacccugacaccugugggccgccucaucaccgccaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaggcuuuugaagccaccgugagaggagcuaaacgcauggccgugcugggcgacaccgccugggauuucggguccgucggaggcgcucucaacucucuggggaaaggcauccaccagaucuucggagcggccuuuaagagccuguucggcgggauguccugguuuucucaaauucuuaucggaacacuccugauguggcugggccucaauacgaagaacgggagcauuucccugaugugucuugcucugggaggcgugcucaucuuccugagcaccgccguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4527 - RNA, 2359 nt, Artificial Sequence
  KU497555.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcacccaggagggggccgugcauacagcccuggcuggcgcccuugaagcugagauggauggagccaagggccgccugucuagcgggcaccucaaaugccggcugaagauggacaaacuuagacugaagggagucuccuauagccucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaaucuaccgaaaauuccaagaugaugcuggagcuugaucccccuuucggggacagcuacauugucaucggcgugggagagaaaaagauuacacaccacuggcaucggucuggcuccaccaucgggaaagccuuugaggcuaccgugagaggagccaagcgcauggcuguccugggcgacacagccugggauuucgggagcgugggaggcgcccucaacucccuggggaaaggcauucaccagaucuucggagcugcguuuaagucucuguucggcgggaugagcugguuuucccaaauccuuauuggaacgcuccugauguggcugggccucaauaccaagaacgggucuaucagccugaugugucuugcccugggaggcguucucauuuuccuguccacagcugugagcgccgacgucgggugcucuguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4528 - RNA, 2359 nt, Artificial Sequence
  KX087101.3 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugagcugcaguacgccgggacagacggaccuugcaaggugcccgcucaaauggccgucgauaugcagacccucacaccugugggccgccugaucaccgcgaaccccgugaucacggaauccacagagaauagcaagaugaugcuugagcuggaucccccuuucggggacucuuacauuguuaucggcgucggagagaaaaagauuacccaccacuggcaucgguccggcagcacaaucgggaaagccuuugaagcuaccgugagaggagccaagcgcauggcugugcucggcgacaccgccugggauuucggguccgucggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcgugcugauuuuccugagcaccgcuguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4529 - RNA, 2359 nt, Artificial Sequence
  KY075932.1 prME-long mRNA Design 1 opt
gggagaaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugcccuaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcaucgaaaacuggauuuuuagaaauccuggcuucgcgcuggccgcugccgcuaucgccuggcuccugggguccagcacgucucagaaagugauuuaucuugucaugauccugcucauugcgcccgccuacuccauccggugcauuggagugagcaaccgcgacuuuguugagggcaugucugggggaacauggguggaugucgugcuggagcauggcgggugugugaccgucauggcucaggacaagccuacaguugauaucgaacuugugaccaccacaguguccaauauggccgaggucagaagcuacugcuaugaggcuucuaucuccgacauggccagcgauucccggugucccacgcaaggagaagccuaccuggacaaacagucugacacccaguaugugugcaagagaacacucguugaucgcggcuggggcaacggguguggacuguucggcaaagggagccuggugaccugcgcuaaguuugcgugcuccaagaaaaugacaggaaagagcauucagccugaaaaucucgaguaccggaucaugcugucuguccacggcucccaacacagcgggaugauugugaacgacaccggacaugagacggaugaaaauagagccaaaguugagaucacaccgaacucuccccgcgcugaagccacccuuggcggcuucgggagccugggacucgacugugagccucggaccggccuggauuuuuccgaccuuuauuaccugacaaugaauaacaagcacuggcucgugcauaaagaaugguuccacgauauuccccugccuuggcacgccggggcugacaccggaacaccccauuggaauaacaaggaggcccuggucgaguuuaaagaugcgcacgcuaagagacagacgguggucgugcucggcucucaggaaggggccguucauaccgcccuggcuggcgcccuugaggcugaaauggacggagccaagggccgccugagcuccgggcaccucaaaugccggcugaagauggauaaacuuagacugaagggagugagcuauucucucuguacagcggccuucaccuuuacaaaaaucccggcugagacccugcauggcacggucaccguggaaguucaguacgccgggacagacggaccuugcaaggugcccgcucaaauggccgucgacaugcagacccugacaccugugggccgccucaucaccgcgaaccccgugauuacggaguccacagagaauagcaagaugaugcuggaacuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgauaccgccugggacuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgauguggggugcuccgucgacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4530 - RNA, 2359 nt, Artificial Sequence
  KY014317.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccauugagaauagcaagaugaugcuggagcuugaucccccuuucggggacucuuacaucgucauuggcgugggagagaaaaagaucacacaccacuggcaucgguccggcagcaccauugggaaagccuuugaagcuacagugagaggagccaagcgcauggcuguccugggcgacaccgccugggauuucggguccgugggaggcgcccucaacucucuggggaaaggcauccaccagaucuucggagcugcguuuaagagccuguucggcgggauguccugguuuucucaaauucuuaucggaacccuccugauguggcugggccucaauacaaagaacgggagcauuucccugaugugucuugcccugggaggcguucucaucuuccugagcacggcugugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4531 - RNA, 2359 nt, Artificial Sequence
  KU758876.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagucaagggccgccugagcuccgggcaccucaaaugccggcugaagauggacaaacuuagacugaagggagugagcuauucucucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaauccacagagaauagcaagaugaugcuggagcuugaucccccuuucggggacucuuacauugugaucggcgugggagagaaaaagauuacccaccacuggcaucgguccggcagcacaaucgggaaagcguuugaagccaccgucagaggagcuaagcgcauggccgugcugggcgacaccgcuugggauuucggguccguuggaggcgcccucaacucucuggggaaaggcauucaccagaucuucggagccgcuuuuaagagccuguucggcgggauguccugguuuucucaaauccuuauuggaacacuccugauguggcugggccucaauacgaagaacgggagcaucuccuucaugugucuggcgcuuggaggcgugcugauuuuucucagcaccgccgucucugcugacguggggugcuccguugauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4532 - RNA, 2359 nt, Artificial Sequence
  KU758874.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggcaaacugagcuccgggcaccucaagugccgccugaaaauggacaaacuucggcugaagggagucagcuauucucucuguacagcggccuucaccuuuacaaagauuccggcugaaacccugcauggcacggugaccguugaggugcaguacgccgggacagacggaccuugcaagguccccgcucaaauggccguggauaugcagacccugacaccugugggcagacucaucaccgcgaaccccguuaucacggaauccacagagaauagcaaaaugaugcuggagcuugaucccccuuucggggacucuuacauugucaucggcgugggagaaaagaaaauuacccaccacuggcaucgcuccggcagcacaaucgggaaggccuuugaggcuaccgugcggggagccaaaagaauggcuguccugggcgacaccgccugggauuucggguccgugggaggcgcccucaacucucuggggaagggcauucaccagaucuucggagcugcguuuaagagccuguucggcgggauguccugguuuucucaaauccuuauuggaacacuccugauguggcugggccucaauacgaaaaacgggagcaucucccugaugugucuugcccugggaggcguucucauuuuccugagcaccgcugugucugccgacgucgggugcuccguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4533 - RNA, 2359 nt, Artificial Sequence
  KY014314.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagaggcgcacgcuaagagacagacggucgugguucucggcucucaggaaggggccgugcauaccgcccuggcuggcgcccuugaggcugaaauggacggagccaagggccgccugagcuccgggcaccucaaaugccggcugaagauggauaaacuuagacugaagggagucagcuauucucucuguacagcggccuucaccuuuacaaaaauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaauagcaagaugaugcuggaacuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgauaccgccugggacuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgaugucgggugcuccguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4534 - RNA, 2359 nt, Artificial Sequence
  KU926310.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccggggcugacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4535 - RNA, 2359 nt, Artificial Sequence
  KU761560.1 prME-long mRNA Design 1 opt
gggagaaagcuuaccaugagaaucauuaacgccggcaaggagaaaaagcggcgcggggcugacaccaaugugggaaucgucggccugcuccugacaacggccauggcggcugaaguuaccagacgggggagcgccuacuauauguaccuugaucgcaacgacgccggagaggcuauuuccuuccccacaacccugggcaugaauaaaugcuauauccagauuauggaucucgggcacaugugugacgccacaaugucuuacgaaugcccuaugcuggaugagggaguggaaccggacgauguggacuguuggugcaacaccacaagcaccugggucguguauggcacgugucaucacaagaaaggcgaggcuagacggucccgcagagccguuacccuucccucucauagcacacggaagcugcaaacccgcucccagacauggcucgagucuagagaauacaccaagcaccugauccggguggagaauuggaucuuucgcaacccuggguucgcgcuggccgcugccgcuauugccuggcuccugggaagcuccacgagccagaaagucaucuaucuugugaugauucugcucaucgcgcccgccuacucuauuagaugcaucggcguuuccaaucgggauuuuguggaagggaugagcggaggcacaugggucgacguggugcuggagcaugggggaugugucaccguuauggcucaggauaagccuacaguggacauugagcuugugaccaccacagucucuaacauggccgaagugcgcuccuacugcuaugaggcuagcaucucugauauggccuccgacagcagaugucccacgcaaggcgaagccuaccuggacaaacaguccgauacccaguauguuugcaagcggacacucguggacagaggcugggggaauggauguggccuguucgggaaaggaucucuggugaccugcgcuaaguuugcgugcagcaagaaaaugacaggcaaguccauccagccugagaaccucgaauaccgcauuaugcugagcguccacgggucucaacacuccggaaugaucguuaaugauaccggccaugagacggacgagaaccgggccaaaguggaaauuacaccgaauagccccagagcugaggccacccuuggcggguucggaucucugggccucgauugugaaccucgcaccgggcuggacuuuagcgaucuuuauuaccugacaaugaacaauaagcacuggcucguccauaaagagugguuccacgacaucccccugccuuggcacgccggagcugauaccggcacaccccauuggaacaacaaggaagcccugguggaguuuaaagacgcgcacgcuaagcggcagacggucgugguucucgggucccaggagggcgccgugcauaccgcccuggcuggagcccuugaagcugagauggauggcgccaaggggagacugucuagcggacaccucaaaugccgccugaagauggacaaacuucggcugaagggcgucuccuauagccucuguacagcggccuucaccuuuacaaaaauuccggcugaaacccugcaugggacggugaccguugaggugcaguacgccggaacagacggcccuugcaagguccccgcucaaauggccguggauaugcagacccugacaccuguggggagacucaucaccgcgaaucccguuaucacggaaucuacagagaacuccaagaugaugcuggagcuugaucccccuuucggcgacagcuacauugucaucggagugggcgagaaaaagauuacccaccacuggcaucgcucuggguccacaaucggaaaagccuuugaagcuaccgugcggggcgccagacgcauggcuguccugggggacaccgccugggauuucggaagcgugggcggggcccucaauucccugggcaagggcauucaccagaucuucggagcugcguuuaaaucucuguucgggggaaugagcugguuuucccaaauccuuauuggcacacuccugauguggcuggggcucaacacgaagaauggaucuaucagccugaugugucuugcccugggcgggguucucauuuuccuguccaccgcugugagcgccgacgucggcugcucuguggauuuuuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4536 - RNA, 2359 nt, Artificial Sequence
  KY317939.1 prME-long mRNA Design 1 opt
gggagaaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaagaugccggggaagcuauuucuuuccccacaacccugggaaugaauaagugcuauauccagauuauggaccucggccacaugugugaugccacaaugagcuacgagugcccuaugcuggacgaagggguggagccggaugacguggauuguuggugcaacaccacauccaccugggucguguauggaacgugucaucacaaaaagggcgaggcucggcgcucuagacgggccguuacccuucccagccauuccacacgcaagcugcaaaccagaucucagacauggcucgaaagccgggaguacaccaaacaccugauccgcguggaaaauuggaucuuuagaaacccuggcuucgcgcuggccgcugccgcuauugccuggcuccugggguccagcacgucucagaaggucaucuaucuugugaugauucugcucaucgcgcccgccuacuccauucggugcaucggaguuagcaaucgcgacuuuguggagggcaugucugggggaacaugggucgauguggugcuggagcauggcgggugugucaccguuauggcucaggacaaaccuacaguggauauugaacuugugaccaccacagucuccaacauggccgaggugagaagcuacugcuaugaggcuucuaucuccgacauggccagcgauucccggugucccacgcaaggagaagccuaccuggacaagcagucugacacccaguauguuugcaaaagaacacucguggaucgcggcuggggcaauggguguggacuguucggcaaggggagccuggugaccugcgcuaaguuugcgugcuccaaaaagaugacaggaaaaagcauccagccugaaaaccucgaguaccggauuaugcugucuguccacggcucccaacacagcgggaugaucguuaaugacaccggacaugagacggaugaaaacagagccaagguggagauuacacccaauucuccgcgcgcugaagccacccuuggcggcuucgggagccugggacucgacugugagccucggaccggccuggauuuuuccgaccuuuauuaccugacaaugaacaauaaacacuggcucguccauaaggaaugguuccacgauaucccccugccuuggcacgccggggcugacaccggaacaccccauuggaacaauaaagaggcccugguggaguuuaaggaugcgcacgcuaagagacagacggucgugguucucggcucucaggaaggggccgugcauaccgcccuggcuggcgcccuugaggcugaaauggacggagccaaaggccgccugagcuccgggcaccucaagugccggcugaaaauggauaaacuuagacugaagggagucagcuauucucucuguacagcggccuucaccuuuacaaagauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaacagcaaaaugaugcuggaacuugaucccccuuucggggacucuuacauugucaucggcgugggagagaagaaaauuacccaccacuggcaucgguccggcagcacaaucgggaaggccuuugaagcuaccgugagaggagccaaacgcauggcuguccugggcgauaccgccugggacuucggguccgugggaggcgcccucaauucucuggggaagggcauucaccagaucuucggagcugcguuuaagagccuguucggcgggauguccugguuuucucaaauccuuauuggaacacuccugauguggcugggccucaacacgaaaaaugggagcaucucccugaugugucuugcccugggaggcguucucauuuuccugagcaccgcugugucugccgaugucgggugcuccguggacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4537 - RNA, 2359 nt, Artificial Sequence
  KY075937.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauaugguuagcgacucccggugucccacgcaaggagaagccuaccuggacaaacagucugauacccaguaugugugcaagagaacacucgucgaccgcggcuggggcaacggguguggacuguucggcaaagggagccuggugaccugcgccaaguuugcuugcuccaagaaaaugacaggaaagagcauccagccugagaaucucgaauaccggauuaugcugucuguucacggcucccaacacagcgggaugaucgugaacgauaccggacaugagacggacgagaauagagcgaaagucgaaauuacaccgaacucuccccgcgccgaggcuacccuuggcggcuucgggagccugggacucgauugugaaccucggaccggccuggacuuuuccgaucuuuauuaccugacaaugaauaacaagcacuggcucgugcauaaagagugguuccacgacaucccccugccuuggcacgccggggccgauaccggaacaccccauuggaauaacaaggaagcucuggucgaguuuaaagacgcccacgcgaagagacagacggugguugugcucggcucucaggagggggcuguccauaccgcccuggccggcgcucuugaagccgagauggauggagcuaagggccgccugagcuccgggcaccucaaaugccggcugaagauggacaaacuuagacugaagggagugagcuauucucucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaauccacagagaauagcaagaugaugcuggagcuugaucccccuuucggggacucuuacauugugaucggcgugggagagaaaaagauuacccaccacuggcaucgguccggcagcacaaucgggaaagcguuugaagccaccgucagaggagcuaagcgcauggccgugcugggcgacaccgcuugggauuucggguccguuggaggcgcccucaacucucuggggaaaggcauucaccagaucuucggagccgcuuuuaagagccuguucggcgggauguccugguuuucucaaauccuuauuggaacacuccugauguggcugggccucaauacgaagaacgggagcaucucccugaugugucuugcgcugggaggcgugcucauuuuccugagcaccgccgucucugcugacguggggugcuccguugauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4538 - RNA, 2359 nt, Artificial Sequence
  LC191864.1 prME-long mRNA Design 1 opt
gggagaaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaugaccagcacaugggucguguauggaaccugucaucacaagaaaggcgaggcucggcgcuccagacgggccguuacgcuucccucucauagcacccgcaagcugcaaacaagaucccagaccuggcucgagucucgggaauacacaaagcaccugauccgcguggagaauuggaucuuuagaaacccuggcuucgcgcuggccgcugccgcuauugccuggcuccuggggagcuccaccagccagaaagucaucuaucuugugaugauucugcucaucgcgcccgccuacucuauucggugcaucggaguuuccaaucgcgauuuuguggaaggcaugagcgggggaacgugggucgacguggugcuggagcauggcgggugugucacaguuauggcucaggauaagccuaccguggacauugagcuugugacaaccaccgucucuaacauggccgaagugagauccuacugcuaugaggcuagcaucucugauauggccuccgacagccggugucccacacaaggagaagccuaccuggacaaacaguccgauacgcaguauguuugcaagagaacccucguggaccgcggcuggggcaauggguguggacuguucggcaaagggucucuggucacaugcgcuaaguuugcgugcagcaagaaaaugaccggaaaguccauccagccugagaaccucgaauaccggauuaugcugagcgugcacggcucucaacacuccgggaugaucguuaaugauacaggacaugagaccgacgagaacagagccaaaguggaaauuacgccgaauagcccccgcgcugaggccacacuuggcggcuucgggucucugggacucgauugugaaccucggaccggccuggacuuuagcgaucuuuauuaccugaccaugaacaauaagcacuggcucguccauaaagagugguuccacgacaucccccugccuuggcacgccggggcugauacaggaacaccccauuggaacaacaaggaagcccugguggaguuuaaagacgcgcacgcuaagagacagaccgucgugguucucggcucccaggagggggccgugcauacggcccuggcuggcgcccuugaagcugagauggauggagccaagggccgccugucuagcgggcaccucaaaugccggcugaagauggacaaacuuagacugaagggagucuccuauagccucuguaccgcggccuucacauuuaccaaaauuccggcugaaacacugcauggcaccgugacgguugaggugcaguacgccgggaccgacggaccuugcaagguccccgcucaaauggccguggauaugcagacacugaccccugugggccgccucaucacagcgaaucccguuaucaccgaaucuacggagaacuccaagaugaugcuggagcuugaucccccuuucggggacagcuacauugucaucggcgugggagagaaaaagauuacacaccacuggcaucggucuggcuccaccaucgggaaagccuuugaagcuacagugagaggagccaagcgcauggcuguccugggcgacaccgccugggauuucgggagcgugggaggcgcccucaauucccuggggaaaggcauucaccagaucuucggagcugcguuuaagucucuguucggcgggaugagcugguuuucccaaauccuuauuggaacccuccugauguggcugggccucaacacaaagaaugggucuaucagccugaugugucuugcccugggaggcguucucauuuuccuguccacggcugugagcgccgacgucgggugcucuguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4539 - RNA, 2359 nt, Artificial Sequence
  KX447517.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccgcccuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaacccuuaucggaacacuccugauguggcugggccucaauacgaagaacgggagcauuucccugaugugucuugcucugggaggcguucucaucuuccugagcaccgccgugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4540 - RNA, 2359 nt, Artificial Sequence
  KU922923.1 prME-long mRNA Design 1 opt
gggagaaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugccccaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcguggaaaacuggaucuuuagaaauccuggcuucgcgcuggccgcugccgcuauugccuggcuccugggguccagcacgucucagaaagucaucuaucuugugaugauucugcucaucgcgcuggccuacuccauucggugcaucggaguuagcaaccgcgacuuuguggagggcaugucugggggaacaugggucgauguggugcuugagcauggcgggugugucaccguuauggcucaggacaagcccacaguggauauugaacuggugaccaccacagucuccaauauggccgaggugagaagcuacugcuaugaggcuucuaucuccgacauggccagcgauucccgguguccuacgcaaggagaagccuaccucgacaaacagucugacacccaguauguuugcaagagaacacugguggaucgcggcuggggcaacggguguggacuguucggcaaagggagccucgugaccugcgcuaaguuugcgugcuccaagaaaaugacaggaaagagcauccagcccgaaaaucuggaguaccggauuaugcuuucuguccacggcucccaacacagcgggaugaucguuaacgacaccggacaugagacggaugaaaauagagccaaaguggagauuacaccuaacucuccgcgcgcugaagccacccugggcggcuucgggagccucggacuggacugugagccccggaccggccuugauuuuuccgaccuguauuaccucacaaugaauaacaagcacuggcugguccauaaagaaugguuccacgauaucccucugcccuggcacgccggggcugacaccggaacaccucauuggaauaacaaggaggcccucguggaguuuaaagaugcgcacgcuaagagacagacggucgugguucugggcucucaggaaggggccgugcauaccgcccuugcuggcgcccuggaggcugaaauggacggagccaagggccgccucagcuccgggcaccugaaaugccggcuuaagauggauaaacugagacucaagggagucagcuauucucuguguacagcggccuucaccuuuacaaaaauucccgcugagacccugcauggcacggugaccguugaagugcaguacgccgggacagacggaccgugcaaggucccugcucaaauggccguggacaugcagacccucacacccgugggccgccugaucaccgcgaacccuguuaucacggaguccacagagaauagcaagaugaugcuugaacuggauccucccuucggggacucuuacauugucaucggcgugggagagaaaaagauuacccaccacuggcaucgguccggcagcacaaucgggaaagccuuugaagcuaccgugagaggagccaagcgcauggcuguccucggcgauaccgccugggacuucggguccgugggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcguucugauuuuccugagcaccgcugugucugccgaugucgggugcuccguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4541 - RNA, 2359 nt, Artificial Sequence
  KY003156.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaauuagcaaccgcgauuuuguugaaggcaugucugggggaacauggguggacgucgugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggauucugggacucgauugugaaccucggaccggccuggacuuuagcgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagagacagacgguggucgugcucggcucccaggagggggccguucauaccgcccuggcuggcgcccuugaagcugagauggauggagccaagggccgccugucuagcgggcaccucaaaugccggcugaagauggacaaacuuagacugaagggaguguccuauagccucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucauuaccgcgaaccccgugaucacggaaucuacagaaaauuccaagaugaugcuggagcuugaucccccuuucggggacagcuacauuguuaucggcgucggagagaaaaagauuacccaccacuggcaucggucuggcuccacaaucgggaaagccuuugaggcuaccgugagaggagccaagcgcauggcugugcugggcgacaccgccugggauuucgggagcgucggaggcgcccucaacucccuggggaaaggcauccaccagauuuucggagcugcguuuaagucucuguucggcgggaugagcugguuuucccaaauccuuauuggaacacuccugauguggcugggccucaauacgaagaacgggucuaucagccugaugugucuugcccugggaggcgugcucauuuuccuguccaccgcuguuagcgccgacguggggugcucugucgauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4542 - RNA, 2359 nt, Artificial Sequence
  KU312313.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacacaugugacgccaccaugagcuacgaaugcccuaugcuggaugaggggguggaaccggacgauguggacuguuggugcaauacaaccuccacgugggucguguauggaaccugucaucacaagaaaggcgaggcucggcgcucuagacgggccguuacacuucccagccauuccauccgcaagcugcaaaccagaucucagacauggcucgagagccgggaauacaccaagcaccugauccgcguggagaacuggauuuuuagaaauccuggcuucgcgcuggccgcugccgcuaucgccuggcuccugggguccagcacgucucagaaagucauuuaucuugugaugauccugcucauugcgcccgccuacuccauccggugcauuggaguuagcaaccgcgauuuuguggaaggcaugucugggggaacaugggucgacguggugcuggagcauggcgggugugucaccguuauggcucaggauaagccuacaguggacaucgagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauuguuaacgauaccggacaugagacggacgagaauagagccaaaguggaaaucacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacauuccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaaucccggcugaaacccugcauggcacggugaccguugaggugcaguacgccgggacagacggaccuugcaagguccccgcucaaauggccguggauaugcagacccugacaccugugggccgccucaucaccgcgaaccccguuauuacggaauccacagagaauagcaagaugaugcuggagcuugaucccccuuucggggacucuuacaucgucauuggcgugggagagaaaaagaucacccaccacuggcaucgguccggcagcacaauugggaaagccuuugaagcuaccgugagaggagccaagcgcauggcuguccugggcgacaccgccugggauuucggguccgugggaggcgcccucaacucucuggggaaaggcauccaccagaucuucggagcugcguuuaagagccuguucggcgggauguccugguuuucucaaauucuuaucggaacacuccugauguggcugggccucaaugccaagaacgggagcauuucccugaugugucuugcucugggaggcguucucaucuuccugagcacggccgugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4543 - RNA, 2359 nt, Artificial Sequence
  KY075935.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucaacggucucgcagagccguuacccuucccagccauuccacacggaagcugcagacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacguggugcuggagcauggcgggugugucaccguuauggcucaagauaagccuacaguggacauugagcuugugaccaccacagucuccaauauggccgaagugcgcagcuacugcuaugaggcuucuaucuccgauauggccagcgacuccagaugucccacgcagggagaagccuaccuggacaaacagucugauacccaguauguuugcaagcggacacucguggacagaggcuggggcaacggguguggacuguucggcaaagggagccuggugaccugcgcuaaguuugcgugcuccaagaaaaugacaggaaagagcauccaaccugagaaucucgaauaccgcauuaugcugucuguccacggcucccagcacagcgggaugaucguuaacgauaccggacaugagacggacgagaaucgggccaaaguggaaauuacaccgaacucucccagagcugaggccacccuuggcggcuucgggagccugggacucgauugugaaccucgcaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagcggcagacggucgugguucucggcucucaggagggggccgugcauaccgcccuggcuggcgcccuugaagcugagauggauggagccaagggcagacugagcuccgggcaccucaaaugccgccugaagauggacaaacuucggcugaagggagucagcuauucucucuguacagcggccuucaccuuuacaaaaauuccggcugaaacccugcauggcacggugaccguugaggugcaauacgccgggacagacggaccuugcaagguccccgcucagauggccguggauaugcagacccugacaccugugggcagacucaucaccgcgaaccccguuaucacggaauccacagagaauagcaagaugaugcuggagcuugaucccccuuucggggacucuuacauugucaucggcgugggagagaaaaagauuacccaccacuggcaucgcuccggcagcacaaucgggaaagccuuugaagcuaccgugcggggagccaagagaauggcuguccugggcgacaccgccugggauuucggguccgugggaggcgcccucaacucucuggggaaaggcauucaccaaaucuucggagcugcguuuaagagccuguucggcgggauguccugguuuucucagauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4544 - RNA, 2359 nt, Artificial Sequence
  KY014320.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaagcgagaucucagaccuggcucgagagccgggaauacacaaagcaccugauccgcguggagaacuggaucuuuagaaauccuggcuucgcccuggcugccgcugccauugcguggcuccugggguccagcaccucucagaaagucaucuaucuugugaugauucugcucaucgcccccgcuuacuccauucggugcaucggaguuagcaaccgcgauuuuguggaaggcaugucugggggaacgugggucgacguggugcuggagcauggcgggugugucacaguuauggcccaggauaagccuaccguggacauugagcuugugacaaccaccgucuccaauauggcugaagugagaagcuacugcuaugaggccucuaucuccgauauggccagcgacucccggugucccacacaaggagaggcuuaccuggacaaacagucugauacgcaguauguuugcaagagaacccucguggaccgcggcuggggcaacggguguggacuguucggcaaagggagccuggucacaugcgcgaaguuugccugcuccaagaaaaugaccggaaagagcauccagccugaaaaucucgaauaccggauuaugcugucugugcacggcucccaacacagcgggaugaucguuaacgauacaggacaugagaccgacgagaauagagcuaaaguggaaauuacgccgaacucuccccgcgccgaggccacacuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4545 - RNA, 2359 nt, Artificial Sequence
  KX827309.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaucugacgccggggaggcuauuagcuuccccacaacccugggaaugaauaaaugcuauauccagauuauggaucucggccacaugugugacgccacaauguccuacgaaugcccuaugcuggaugaggggguggaaccggacgauguggacuguuggugcaacaccacaucuaccugggucguguauggaacgugucaucacaagaaaggcgaggcucggcgcagcagacgggccguuacccuucccucccauucuacacgcaagcugcaaaccagaagccagacauggcucgagucccgggaauacaccaagcaccugauccgcguggagaauuggaucuuuagaaacccuggcuucgcgcuggccgcugccgcuauugccuggcuccuggggagcucuacgucccagaaagucaucuaucuugugaugauucugcucaucgcgcccgccuacagcauucggugcaucggaguuucuaaucgcgauuuuguggaaggcauguccgggggaacaugggucgacguggugcuggagcauggcgggugugucaccguuauggcucaggauaagccuacaguggacauugagcuugugaccaccacagucagcaacauggccgaagugagaucuuacugcuaugaggcuuccaucagcgauauggccuccgacucucggugucccacgcaaggagaagccuaccuggacaaacagagcgauacccaguauguuugcaagagaacacucguggaccgcggcuggggcaauggguguggacuguucggcaaagggucccuggugaccugcgcuaaguuugcgugcagcaagaaaaugacaggaaagucuauccagccugagaaccucgaauaccggauuaugcuguccguccacggcagccaacacucugggaugaucguuaaugauaccggacaugagacggacgagaacagagccaaaguggaaauuacaccgaauagcccccgcgcugaggccacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgccggggcugauaccggaacaccccauuggaacaauaaggaagcccugguggaguuuaaagacgcgcacgcuaagagacagacggucgugguucucggcagccaggagggggccgugcauaccgcccuggcuggcgcccuugaagcugagauggauggagccaagggccgccuguccagcgggcaccucaaaugccggcugaagauggacaaacuuagacugaagggagucucuuauucccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaaagcacagagaacucuaagaugaugcuggagcuugaucccccuuucggggacuccuacauugucaucggcgugggagagaaaaagauuacccaccacuggcaucggagcggcuccacaaucgggaaagccuuugaagcuaccgugagaggagccaagcgcauggcuguccugggcgacaccgccugggauuucgggucugugggaggcgcccucaauagccuggggaaaggcauucaccagaucuucggagcugcguuuaagucccuguucggcgggaugucuugguuuagccaaauccuuauuggaacacuccugauguggcugggccucaacacgaagaauggguccaucagccugaugugucuugcccugggaggcguucucauuuuccugucuaccgcuguguccgccgacgucgggugcagcguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4546 - RNA, 2359 nt, Artificial Sequence
  KU681081.3 prME-long mRNA Design 1 opt
gggagaaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacacaggggccgauacgggaacaccccauuggaacaauaaggaagcccugguggaguuuaaagacgcucacgccaagagacagaccgucgugguucucggcagccaggagggggcggugcauaccgcucuggccggcgcccuugaagcugagauggauggagccaagggccgccuguccagcgggcaccucaaaugccggcugaagauggacaaacuuagacugaagggagucucuuauucccucuguacagcugccuucaccuuuacgaaaauuccggcggaaacccugcauggcacagugaccguugaggugcaguacgccgggacagacggaccuugcaagguccccgcucaaauggccguggauaugcagacccugacgccugugggccgccucaucacagcuaaccccguuaucaccgaagggacagagaacagcaagaugaugcuggagcuugaucccccuuucggcgacucuuacauugucaucggagugggcgagaaaaagauuacccaccacuggcaucgguccgggagcaccaucggaaaagccuuugaagcgacagugagaggcgccaagcgcauggcuguccugggggacacggccugggauuucggauccgugggcgggguucucaauucucugggcaaaggcauucaccagaucuucggagcugccuuuaagagccuguucgggggaauguccugguuuucucaaauccuuauuggcacccuccugauguggcuggggcucaacacaaagaauggaagcaucucccugaugugucuugcccugggcggggugcucauuuuccugagcaccgcugucucugcggacgugggcugcuccguugauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4547 - RNA, 2359 nt, Artificial Sequence
  KU744693.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccgcuauggcccaggauaagccuacaguugacauugagcuugugaccaccacaguguccaauauggcugaagucagaagcuacugcuaugaggccucuaucuccgauauggccagcgacucccggugucccacgcaaggagaggcuuaccuggacaaacagucugauacccaguaugugugcaagagaacacucguugaccgcggcuggggcaacggguguggacuguucggcaaagggagccuggugaccugcgcgaaguuugccugcuccaagaaaaugacaggaaagagcauccagccugaaaaucucgaauaccggauuaugcugucuguccacggcucccaacacagcgggaugcuugugaacgauaccggacaugagacggacgagaauagagcuaaaguugaaaucacaccgaacucuccccgcgccgaggccacccugggcggcuucgggagccucggacuggauugugaaccucggaccggccuugacuuuuccgaucuguauuaccucacaaugaauaacaagcacuggcuggcucauaaagagugguuccacgacauuccccugccuuggcacgccggggcggcuaccggaacaccccauuggaauaacaaggaagcccucguggaguuuaaagaugcccacgcuaagagacagacggucgugguccugggcucucaggagggggccgugcauaccgcucuugccggcgcgcuggaagccgagauggacggagcuaagggccgccucagcuccgggcaccugaaaugccggcuuaagauggauaaacugagacucaagggaguuagcuauucucuguguacagccgcuuucaccuuuacaaaaaucccggccgaaaccguggacggcacggucaccguggaggggcaguacggaggcacagacgggccuugcaagguucccgcgcaaauggccguggauaugcagacccugacaccugucggccgccucauuaccgcuaaccccgugaucacggaauccacagagaauagcaagaugaugcuggagcuugaucccccuuucggagacucuuacaucgugauuggcguuggggagaaaaagaucacccaucacuggcaccgguccggaagcacaauuggcaaagccuuugaagcuaccgucagaggggccaagcgcauggccgugcugggagacaccgcuugggauuucggcuccgucgggggcgcgcucaacucucugggaaaaggcauccaucagauuaucggggccgcuuucaagagccuguuuggaggcauguccugguucucucaaauccuuauugggacacuccugauguggcugggacucaauacgaagaacggcagcaucucccugaugugucuugcccucgggggcgugcugauuuuucugagcaccgccgugucuggaggcguugggugcuccguggacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4548 - RNA, 2359 nt, Artificial Sequence
  KY328290.1 prME-long mRNA Design 1 opt
gggagaaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuagcaaaauuccggccgaaacccugcauggcacggugaccgaggaaguucaguacgcugggacagacggaccuugcaaggugcccgcccaaauggcugucgauaugcagacccugacaccugugggccgccucaucaccgccaaccccgugaucacggagucuacagagaacuccaagaugaugcuggaacuugaucccccuuucggggacagcuacauuguuaucggcgucggagagaaaaagauuacccaccacuggcaucgguccggcucuacaaucgggaaagcguuugaagccaccgugagaggagcuaagcgcauggccgugcugggcgacaccgcuugggauuucgggagcgucggaggcgcccucaauucccuggggaaaggcauucaccagaucuucggagccgcuuuuaagucucuguucggcgggaugagcugguuuucccaaauccuuauuggaacacuccugauguggcugggccucaacacgaagaaugggagcaucucucugaugugucuugcgcugggaggcgugcucauuuuccuguccaccgccguuagcgcugacguggggugcucugucgauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4549 - RNA, 2359 nt, Artificial Sequence
  KX694532.2 prME-long mRNA Design 1 opt
gggagaaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuaccaaaauuccggccgaaacgcugcauggcaccgugacaguugaggugcaguacgcugggaccgacggaccuugcaagguccccgcccaaauggcuguggauaugcagacacugaccccugugggccgccucaucacggccaaccccguuaucacagaaagcaccgagaacucuaagaugaugcuggagcuugaucccccuuucggggacuccuacauugucaucggcgugggagagaaaaagauuacacaccacuggcaucggagcggcuccaccaucgggaaagcguuugaagccaccgugagaggagcuaagcgcauggccguccugggcgacacagcuugggauuucgggucugugggaggcgcccucaauagccuggggaaaggcauucaccagaucuucggagccgcuuuuaagucccuguucggcgggaugucuugguuuagccaaauccuuauuggaacgcuccugauguggcugggccucaacaccaagaauggguccaucagccugaugugucuugcgcugggaggcguucucauuuuccugucuacagccguguccgcugacgucgggugcagcguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4550 - RNA, 2359 nt, Artificial Sequence
  KU955593.1 prME-long mRNA Design 1 opt
gggagaaagcuuaccaugagaaucauuaacgcccggaaggagaaaaagcgcagaggcaccgacacaagcguggggaucgucggacugcuccugacgaccgcuauggccguugaagugacacggcgcggcaaugcguacuauauguaccuugauagauccgacgcuggggaggccauuucuuuccccaccacaaugggaaugaacaaaugcuauauccagauuauggaucugggccacaugugugacgccaccaugagcuacgaaugcccuaugcucgaugaggggguggaaccggacgaugucgacuguuggugcaauacaaccuccacgugggugguuuauggaaccugucaucacaagaaaggcgaggcucggcgcucuagacgggccgugacacugcccagccauuccacccgcaaacuucaaacaagaucucagaccuggcuggagagccgggaauacacgaagcaccucauccgcgucgagaacuggaucuuuagaaauccuggcuucgcucuggccgcggccgcuauugccuggcugcucggguccagcacaucucagaaagugaucuaucugguuaugauucuucugaucgcucccgccuacuccauucggugcaucggagugagcaaccgcgauuuugucgaaggcaugucugggggaaccuggguggacgugguccucgagcauggcggguguguuacagugauggcgcaggauaagccuaccguggacauugagcuggucaccacaacgguguccaauauggccgaaguuagaagcuacugcuaugaggcuucuaucuccgauauggccagcgacucccggugucccacccaaggagaggcuuaccuugacaaacagucugauacacaguaugugugcaagagaacccuggucgaccgcggcuggggcaacggguguggacucuucggcaaagggagccuggugacaugcgccaaguuugccugcuccaagaaaaugaccggaaagagcauccagccugaaaaucuggaauaccggauuaugcucucuguucacggcucccaacacagcgggaugaucgugaacgauacgggacaugagacagacgagaauagagcuaaagucgaaauuaccccgaacucuccccgcgcggaggccacccugggcggcuucgggagccuuggacuggauugugaaccucggacaggccucgacuuuuccgaucuguauuaccuuaccaugaauaacaagcacuggcuggugcauaaagagugguuccacgacaucccccucccuuggcacgcuggggccgauacaggaacgccccauuggaauaacaaggaagcccuggucgaguuuaaagacgcucacgccaagagacagaccgugguugugcugggcucucaggagggggcgguccauacagcucucgccggcgcccuggaagcugagauggauggagccaagggccgccuuagcuccgggcaccugaaaugccggcucaagauggacaaacugagacuuaagggagugagcuauucucuguguaccgcugccuucacauuuaccaaaauuccggcggaaacgcuccauggcaccguuacaguggagguccaguacgccgggaccgacggaccuugcaaggugcccgcucaaauggccguggauaugcagacacugaccccuguuggccgccugaucacggcuaaccccgucaucacagaauccaccgagaauagcaagaugaugcucgagcuggaucccccuuucggggacucuuacauugugaucggcgugggagaaaagaagauuacacaccacuggcaucgguccggcagcaccaucgggaaagccuuugaggcgaccgucagaggagccaagcgcauggcugugcuuggcgacacagccugggauuucggguccguuggaggcgcucugaacucucucgggaaaggcauucaccagaucuucggagccgccuuuaagagccuguucggcgggauguccugguuuucucaaauccugauuggaacgcuucucguguggcugggccugaauaccaagaacgggagcaucucccucaugugucuggcucuuggaggcguccugauuuuccucagcacagcggugucugccgacguugggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4551 - RNA, 2359 nt, Artificial Sequence
  KY272987.1 prME-long mRNA Design 1 opt
gggagaaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuaccaaaauuccggccgaaacgcugcauggcaccgugacaguugaggugcaguacgcugggaccgacggaccuugcaagguccccgcccaaauggcuguggauaugcagacacugaccccugugggccgccucaucacggccaaccccguuaucacagaaagcaccgagaacucuaagaugaugcuggagcuugaucccccuuucggggacuccuacauugucaucggcgugggagagaaaaagauuacacaccacuggcaucggagcggcuccaccaucgggaaagcguuugaagccaccgugagaggagcuaagcgcauggccguccugggcgacacagcuugggauuucgggucugugggaggcgcccucaauagccuggggaaaggcauucaccagaucuucggagccgcuuuuaagucccuguucggcgggaugucuugguuuagccaaauccuuauuggaacgcuccugauguggcugggccucaacaccaagaauggguccaucagccugguuugucuugcgcugggaggcgugcucauuuuccugucuacagccgucuccgcugacguggggugcagcguugauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4552 - RNA, 2359 nt, Artificial Sequence
  EU545988.1 prME-long mRNA Design 1 opt
gggagaaagcuuaccaugagaaucauuaacgcccggaaggagaaaaagcgcagaggcaccgacacaagcguggggaucgucggacugcuccugacgaccgcuauggccguugaagugacacggcgcggcuccgcguacuauauguaccuugauagaucugacgcuggggaggccauuagcuuccccaccacacugggaaugaauaaaugcuauauccagauuauggaucucggccacaugugugacgccaccauguccuacgaaugcccuaugcuggaugaggggguggaaccggacgaugucgacuguuggugcaacacaaccucuacgugggugguuuauggaaccugucaucacaagaaaggcgaggcucggcgcagcagacgggccgugacacuucccucccauucuacccgcaagcugcaaacaagaagccagaccuggcucgagucccgggaauacacgaagcaccugauccgcgucgagaauuggaucuuuagaaacccuggcuucgcucuggccgcggccgcuauugccuggcuccuggggagcucuacaucccagaaagugaucuaucuuguuaugauucugcucaucgcucccgccuacagcauucggugcaucggagugucuaaucgcgauuuugucgaaggcauguccgggggaaccuggguggacgugguccuggagcauggcggguguguuacagugauggcgcaggauaagccugccguggacauugagcuugucaccaccacagugagcaacauggcugaaguuagaucuuacugcuaugaggccuccaucagcgauauggcuuccgacucucggugucccacgcaaggagaagccuaccuggacaaacagagcgauacccaguaugugugcaagagaacacucgucgaccgcggcuggggcaauggguguggacuguucggcaaagggucccuggugaccugcgccaaguuugcuugcagcaagaaaaugacaggaaagucuauccagccugagaaccucgaauaccggauuaugcuguccguucacggcagccaacacucugggaugaucgugaaugauaccggacaugagacggacgagaacagagcgaaagucgaaauuacaccgaauagcccccgcgccgaggcuacccuuggcggcuucgggucccugggacucgauugugaaccucggaccggccuggacuuuucugaucuuuauuaccugacaaugaacaauaagcacuggcucgugcauaaagagugguuccacgacaucccccugccuuggcacgccggggccgauaccggaacaccccauuggaacaauaaggaagcucuggucgaguuuaaagacgcccacgcgaagagacagacggugguugugcucggcagccaggagggggcuguccauaccgcccuggccggcgcucuugaagccgagauggauggagcuaagggccgccuguccagcgggcaccucaaaugccggcugaagauggacaaacuuagacugaagggagugucuuauucccucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaaagcacagagaacucuaagaugaugcuggagcuugaucccccuuucggggacuccuacauugugaucggcgugggagagaaaaagauuacccaccacuggcaucggagcggcuccacaaucgggaaagcguuugaagccaccgucagaggagcuaagcgcauggccgugcugggcgacaccgcuugggauuucgggucuguuggaggcgcccucaauagccuggggaaaggcauucaccagaucuucggagccgcuuuuaagucccuguucggcgggaugucuugguuuagccaaauccuuauuggaacacuccugguguggcugggccucaacacgaagaauggguccaucagccugaccugucuugcgcugggaggcguccucauuuuccugucuacagccguguccgcugacguugggugcagcguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4553 - RNA, 2359 nt, Artificial Sequence
  KU681082.3 prME-long mRNA Design 1 opt
gggagaaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccggggaggccauuagcuuccccacaacccugggaaugaauaaaugcuauauccagauuauggaucucggccacaugugugacgcuacaauguccuacgaaugcccuaugcuggaugaggggguggaaccggacgaugucgacuguuggugcaacaccacaucuaccugggugguuuauggaacgugucaucacaagaaaggcgaggcccggcgcagcagacgggcugugacccuucccucccauucuacacgcaagcugcaaaccagaagccagacauggcucgagucccgggaauacaccaagcaccugauccgcgucgagaauuggaucuuuagaaacccuggcuucgcccuggcggccgcugugauugccuggcuccuggggagcucuacgucccagaaaguuaucuaucuugugaugauucugcucaucgcucccgccuacagcauucggugcaucggagucucuaaucgcgauuuuguggaaggcauguccgggggaacauggguggacgucguucuggagcauggcgggugugugaccgugauggcgcaggauaagccuacagucgacauugagcuugugaccaccacaguuagcaacauggccgaagugagaucuuacugcuaugaggcuuccaucagcgauauggccuccgacucucggugucccacgcaaggagaggcuuaccuggacaaacagagcgauacccaguaugucugcaagagaacacucguggaccgcggcuggggcaauggguguggacuguucggcaaagggucccugguuaccugcgccaaguuugccugcagcaagaaaaugacaggaaagucuauccagccugaaaaccucgaauaccggauuaugcuguccgugcacggcagccaacacucugggaugaucgucaaugauaccggacaugagacggacgagaacagagcuaaaguggaaauuacaccgaauagcccccgcgcggaggccacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgcuggggccgauaccggaacaccccauuggaacaauaaggaagcccugguggaguuuaaagacgcucacgccaagagacagacgguugugguccucggcagccaggagggggcggugcauaccgcucuggccggcgcccuugaagcugagauggauggagccaagggccgccuguccagcgggcaccucaaaugccggcugaagauggacaaacuuagacugaagggaguuucuuauucccucuguacagcugccuucaccuuuacaaaaauuccggcggaaacccugcauggcacggugaccgucgaggugcaguacgccgggacagacggaccuugcaaggugcccgcucaaauggccguugauaugcagacccugacaccugucggccgccucaucaccgcuaaccccgugaucacggaaagcacagagaacucuaagaugaugcuggagcuugaucccccuuucggggacuccuacauugugaucggcgucggagagaaaaagauuacccaccacuggcaucggagcggcuccacaaucgggaaagccuuugaagcgaccgugagaggagccaagcgcauggcuguucugggcgacaccgccugggauuucgggucugugggaggcgcucucaauagccuggggaaaggcauucaccagaucuucggagccgccuuuaagucccuguucggcgggaugucuugguuuagccaaauccuuauuggaacacuccuggucuggcugggccucaacacgaagaauggguccaucagccugaccugucuugcucugggaggcgugcucauuuuccugucuacagcgguuuccgccgacguggggugcagcgucgauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4554 - RNA, 2359 nt, Artificial Sequence
  KX601167.1 prME-long mRNA Design 1 opt
gggagaaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccggggaggccauuagcuuccccacaacccugggagugaauaaaugcuauauccagauuauggaucucggccacaugugugacgcuacaauguccuacgaaugcccuaugcuggaugagggggucgaaccggacgauguggacuguuggugcaacaccacaucuaccuggguuguguauggaacgugucaucacaagaaaggcgaggcccggcgcagcagacgggcugucacccuucccucccauucuacacgcaagcugcaaaccagaagccagacauggcucgagucccgggaauacaccaagcaccugauccgcguggagaauuggaucuuuagaaacccuggcuucgcccuggcggccgcugccauugcuuggcuccuggggagcucuacgucccagaaaguuaucuaucuugugaugauucugcucaucgcccccgcguacagcauucggugcaucggagucucuaaucgcgauuuuguggaaggcauguccgggggaacauggguggacgucguucuggagcauggcgggugugugaccgugauggcccaggauaagccuacagucgacauugagcuugugaccaccacaguuagcaacauggcugaagugagaucuuacugcuaugaggccuccaucagcgauauggcuuccgacucucggugucccacgcaaggagaagccuaccuggacaaacagagcgauacccaguaugucugcaagagaacacucguggaccgcggcuggggcaauggguguggacuguucggcaaagggucccugguuaccugcgccaaguuugcuugcagcaagaaaaugacaggaaagucuauccagccugagaaccucgaauaccggauuaugcuguccgugcacggcagccaacacucugggaugaucgucaaugauaccggacaugagacggacgagaacagagcgaaaguggaaauuacaccgaauagcccccgcgccgaggcuacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgccggggccgauaccggaacaccccauuggaacaauaaggaagcucugguggaguuuaaagacgcccacgcgaagagacagacgguugugguccucggcagccaggagggggcugugcauaccgcccuggccggcgcucuugaagccgagauggauggagcuaagggccgccuguccagcgggcaccucaaaugccggcugaagauggacaaacuuagacugaagggaguuucuuauucccucuguacagccgcguucaccuuuacaaaaauuccggccgaaacccugcauggcacggugaccgucgaggugcaguacgcugggacagacggaccuugcaaggugcccgcccaaauggcuguugauaugcagacccugacaccugucggccgccucaucaccgccaaccccgugaucacggaaagcacagagaacucuaagaugaugcuggagcuugaucccccuuucggggacuccuacauugugaucggcgucggagacaaaaagauuacccaccacugguaucggagcggcuccacaaucgggaaagcguuugaagccaccgugagaggagcuaagcgcauggccguucugggcgauaccgcuugggacuucgggucugugggaggcgcccucaauagccuggggaaaggcauucaucagaucuucggagccgcuuuuaagucccuguucggcgggaugucuugguuuagccaaauccuuauuggaacacuccuggucuggcugggccucaacacgaagaauggguccaucagccugaccugucuugcgcugggaggcgugcucauuuuccugucuacagccguuuccgcugauguggggugcagcgucgacuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4555 - RNA, 2359 nt, Artificial Sequence
  KX694533.2 prME-long mRNA Design 1 opt
gggagaaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccgggaaagccauuagcuuccccacaacccugggagugaauaagugcuauauccagauuauggaucucggccacaugugugacgcuacaauguccuacgagugcccuaugcuggaugaaggggucgagccggacgauguggacuguuggugcaacaccacaucuaccuggguuguguauggaacgugucaucacaaaaagggcgaagcccggcgcagcagacgggcugucacccuucccucccauucuacacgcaagcugcaaaccagaagccagacauggcucgagucccgggaguacaccaaacaccugauccgcguggaaaauuggaucuuuagaaacccuggcuucgcccuggcggccgcugccauugcuuggcuccuggggagcucuacgucccagaagguuaucuaucuugugaugauucugcucaucgcccccgcguacagcauucggugcaucggagucucuaaucgcgauuuuguggagggcauguccgggggaacauggguggacgucguucuggaacauggcgggugugugaccgugauggcccaggauaaaccuacagucgacauugagcuugugaccaccacaguuagcaacauggcugaggugagaucuuacugcuaugaagccuccaucagcgauauggcuuccgacucucggugucccacgcaaggagaggccuaccuggacaagcagagcgauacccaguaugucugcaaaagaacacucguggaccgcggcuggggcaauggguguggacuguucggcaaggggucccugguuaccugcgccaaguuugcuugcagcaaaaagaugacaggaaaaucuauccagccugaaaaccucgaguaccggauuaugcuguccgugcacggcagccaacacucugggaugaucgucaaugauauuggacaugaaaccgacgagaacagagcgaagguggagaucacgccgaauagcccccgcgccgaagcuacacuuggcggcuucgggucccugggacucgauugugagccucggaccggccuggacuuuucugaucuuuauuaccugaccaugaacaauaaacacuggcucguccauaaggaaugguuccacgacauuccccugccuuggcacgccggggccgauacaggaacaccccauuggaacaauaaagaggcucugguggaauuuaaggacgcccacgcgaagagacagacaguugugguccucggcagccaggagggggcugugcauacggcccuggccggcgcucuugaggccgaaauggauggagcuaaaggccgccuguccagcgggcaccucaagugccggcugaaaauggacaaacuuagacugaagggaguuucuuauucccucuguaccgccgcguucacauuuaccaagaucccggccgagacacugcauggcaccgugacggucgaagugcaguacgcugggaccgacggaccuugcaaggugcccgcccaaauggcuguugauaugcagacacugaccccugucggccgccucaucacagccaaccccgugauuaccgagagcacggaaaacucuaaaaugaugcuggagcuugaucccccuuucggggacuccuacaucgugauuggcgucggagacaagaaaaucacacaccacuggcaucggagcggcuccaccauugggaaggcguuugaggccacagugagaggagcuaaacgcauggccguucugggcgauaccgcuugggacuucgggucugugggaggcgcccucaauagccuggggaagggcauccaccagaucuucggagccgcuuuuaagucccuguucggcgggaugucuugguuuagccaaauucuuaucggaacccuccuggucuggcugggccucaacaccaaaaauggguccauuagccugacgugucuugcgcugggaggcgugcucaucuuccugucuaccgccguuuccgcugauguggggugcagcgucgacuuuucuaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4556 - RNA, 2359 nt, Artificial Sequence
  KY288905.1 prME-long mRNA Design 1 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucacgcuggucgccguggcuaucgccuggcuccuggggagcucuacaucccagaagguuauuuaccuugugaugauccugcucauugcuccugccuauagcauccggugcauuggagucucuaaucgcgauuuuguggagggcauguccgggggaaccuggguggacgucguucuggaacacggcgggugugugacagugauggcgcaggauaaacccaccgucgacaucgagcuugugaccacaacgguuagcaacauggccgaggugagaucuuacugcuacgaagccuccaucagcgauauggcuuccgacucucgguguccuacccaaggagaggcuuaucuggacaagcagagcgauacacaguacgucugcaaaagaacccucguggaccgcggcuggggcaauggguguggacuguucggcaaggggucccugguuacaugcgccaaguuuaccugcagcaaaaagaugacgggaaaaucuauucagcccgaaaaccucgaguaucggaucaugcuguccgugcacggcagccaacauucugggaugauugucaaugauacaggacacgaaaccgacgagaacagagccaagguggaggucaccccuaauagcccgcgcgcugaagcgacacuuggcggcuucgggucccugggacucgauugugagccccggaccggccuggacuuuucugaucuuuacuaucugacaaugaacaauaaacauuggcucgugcacaaggaaugguuccacgacaucccucugcccuggcaugccggggcugauacgggaaccccucacuggaacaauaaagaggcccugguugaauuuaaggacgcccaugcuaagagacagacaguggucgugcucggcagccaggagggggccguucacaccgcgcuggcuggcgcccuugaggccgaaauggauggagcuaaaggccgccuguucuccgggcaucucaagugccggcugaaaauggacaaacuuagacugaaaggagugagcuacucucucuguacagccgcuuuuaccuucacgaagguccccgccgagacccugcacggcacagugaccguggaaguucaguaugcggggacagacggaccgugcaaggucccugcccaaauggcuguggauaugcagacccugacgcccgugggccgccucauuacagccaacccugucaucaccgaguccacagaaaacagcaaaaugaugcuggagcuugacccucccuuuggggauucuuacaucgugauuggcguuggagacaagaaaaucacccaccauuggcaccgguccggcagcaccauugggaaggcuuucgaggccacagugagaggagcgaaacgcauggccguccugggcgauacggcuugggacuucggguccgugggaggcguuuuuaauucucucgggaagggcauccaucagauuuucggagccgcuuuuaagagccuguucggcgggauguccugguuuucucaaauccugaucggaacccuucucguguggcugggccugaacacaaagaaugggagcauuucccucaccugucuggcccuuggaggcgucaugaucuuccugagcacagccgugucugcugauguugggugcuccguggacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4557 - RNA, 2359 nt, Artificial Sequence
  KF268950.1 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaaucugggagugaacaaaugccacguccagaucauggaucucggccauaugugugacgcuaccauguccuaugagugccccaugcuggaugaagggguugagcccgacgauguggacuguuggugcaauacaaccucuacauggguggucuacggaaccugucaccauaagaaaggcgaagcccgcagaagccggcgcgcggugacgcuuccgucccacucuaccagaaagcugcaaacacggagccagaccuggcucgagucccgcgaguauacaaagcaucugauuaaaguugaaaacuggaucuuuagaaaucccggcuucgcccuggcugccguggcuauugccuggcuccuggggagcucuaccucccagaaggucaucuaccuugugaugauucugcucaucgcgccugccuauagcauucggugcaucggaguuucuaaccgcgauuuuguggagggcauguccgggggaacgugggucgacguggugcuggaacacggcgggugugucacaguuauggcucaggauaaacccaccguggacaucgagcuugugacaaccaccgucagcaauauggccgaggugagaucuuacugcuacgaggcuuccauuagcgauauggccuccgacucucgguguccuacacaaggagaagccuaucuggacaagcagagcgauacgcaguacguuugcaaaagaacccucguggaccgcggcuggggcaacggguguggacuguucggcaaggggucccuggucacaugcgcuaaguuuaccugcagcaaaaagaugacaggaaaaucuauccagcccgaaaaucucgaguaucggauuaugcuguccgugcacggcagccaacauucugggaugaucguuaacgauauuggacacgaaaccgacgagaauagagcgaagguggaggucacgccuaacagcccgcgcgccgaagcuacacuuggcggcuucgggucccugggacucgauugugagccccggaccggccuggacuuuucugaucuuuacuaucugaccaugaauaacaaacauuggcucgugcacaaggaaugguuccacgacaucccucugcccuggcaugccggggccgauacaggaaccccucacuggaauaacaaagaggcucuggucgaauuuaaggacgcccaugcgaagagacagacagugguugugcucggcagccaggagggggcuguccacacggcccuggccggcgcucuugaggccgaaauggauggagcuaaaggccgccuguucuccgggcaucucaagugccggcugaaaauggacaaacuuagacugaaaggagugagcuacucucucuguaccgccgcguuuacauucaccaagguucccgccgagacacugcacggcaccgugacggucgaagugcaguaugcugggaccgacggaccgugcaaggugccugcccaaauggcuguugauaugcagacacugacccccgucggccgccucaucacagccaacccugugauuaccgaguccacggaaaauagcaaaaugaugcuggagcuugacccucccuuuggggauucuuacaucgugauuggcgucggagacaagaaaaucacacaccauuggcaccgguccggcagcaccauugggaaggcguucgaggccacagugagaggagcuaaacgcauggccguucugggcgauaccgcuugggacuucggguccgugggaggcgucuuuaacucucucgggaagggcgugcaucagaucuucggagccgccuuuaagagccuguucggcgggauguccugguuuucucaaauccugauuggaacccuucucguuuggcugggccugaauacaaagaacgggagcaucucccucacgugucuggcucuuggaggcgugaugauuuuccugagcaccgcggucucugccgauguggggugcuccguugacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4558 - RNA, 2359 nt, Artificial Sequence
  KF383121.1 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucgugaaugauauuggacacgaaacggacgagaacagagcuaaggucgaggugacaccuaauagcccgcgcgcggaagccacccuuggcggcuucgggucccugggacucgauugugagccccggaccggccuggacuuuucugaucuuuacuaucugacaaugaacaauaaacauuggcucguccacaaggaaugguuccacgacaucccucugcccuggcaugcuggggccgauaccggaacaccucacuggaacaauaaagaggcccugguggaauuuaaggacgcucaugccaagagacagacgguugugguccucggcagccaggagggggcggugcacaccgcucuggccggcgcccuugaggcugaaauggauggagccaaaggccgccuguucuccgggcaucucaagugccggcugaaaauggacaaacuuagacugaagggaguuagcuacucucucuguacagcugccuuuaccuucacaaaggugcccgcggagacccugcacggcacggucaccguggaagugcaguaugccgggacagacggaccgugcaagguuccugcucaaauggccgucgauaugcagacccugacacccgugggccgccucaucaccgcuaacccugugauuacggaguccacagaaaacagcaaaaugaugcuggagcuugacccucccuuuggggauucuuacaucgucauuggcgugggagacaagaaaaucacccaccauuggcaccgguccggcagcacaauugggaaggccuucgaggcgaccguuagaggagccaaacgcauggcugugcugggcgauaccgccugggacuucggguccgucggaggcguguuuaauucucucgggaagggcauccaucagaucuucggagcugccuuuaagagccuguucggcgggauguccugguuuucucaaauucugaucggaacacuucucguuuggcugggccugaacacgaaaaaugggagcauuucccucaccugucuggcccuuggaggcgugaugaucuuccugagcacagcugucucugcggauguggggugcuccguugacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4559 - RNA, 2341 nt, Artificial Sequence
  KF268949.1 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaaucugggagugaacaaaugccacguccagaucauggaucucggccauaugugugacgcuaccauguccuaugagugccccaugcuggaugaagggguugagcccgacgauguggacuguuggugcaauacaaccucuacauggguggucuacggaaccugucaccauaagaaaggcgaagcccgcagaagccggcgcgcggugacgcuuccgucccacucuaccagaaagcugcaaacacggagccagaccuggcucgagucccgcgaguauacaaagcaucugauuaaaguugaaaacuggaucuuuagaaaucccggcuucgcccuggcugccguggcuauugccuggcuccuggggagcucuaccucccagaaggucaucuaccuugugaugauucugcucaucgcgccugccuauagcauucggugcaucggaguuucuaaccgcgauuuuguggagggcauguccgggggaacgugggucgacguggugcuggaacacggcgggugugucacaguuauggcucaggauaaacccaccguggacaucgagcuugugacaaccaccgucagcaauauggccgaggugagaucuuacugcuacgaggcuuccauuagcgauauggccuccgacucucgguguccuacacaaggagaagccuaucuggacaagcagagcgauacgcaguacguuugcaaaagaacccucguggaccgcggcuggggcaacggguguggacuguucggcaaggggucccuggucacaugcgcuaaguuuaccugcagcaaaaagaugacaggaaaaucuauccagcccgaaaaucucgaguaucggauuaugcuguccgugcacggcagccaacauucugggaugaucguuaacgaugaaaauagagcgaagguggaggucaccccuaacagcccgcgcgccgaggcuacgcuuggaggcuucggcucccuggggcucgacugugaaccccggacaggacuggauuuuucugaccuuuacuaucugaccaugaauaacaaacacuggcucgugcauaaggagugguuccacgauauuccucugcccuggcacgccggcgccgacaccgggacaccucauuggaauaacaaagaagcucuggucgaguuuaaggaugcccacgcgaagagacagaccgugguugugcucggaagccaggaaggcgcuguccauacagcccuggccggggcucuugaggccgagauggacggcgcuaaaggacgccuguucuccggccaccucaagugccggcugaaaauggauaaacuuagacugaagggggugagcuacucucucuguacggccgcguuuaccuucacaaagguucccgccgaaacccugcauggaacagugaccgucgaggugcaguaugcuggcacggacgggccgugcaaggugccugcccaaauggcuguugacaugcagacccugacacccgucggacgccucaucaccgccaacccugugaucacagaauccaccgagaauagcaaaaugaugcuggaacuugauccucccuuuggcgacucuuacauugugaucggggucggcgauaagaaaauuacgcaccacuggcaucgguccggaagcacaaucggcaaggcguucgaggccaccgugagaggggcuaaacgcauggccguucugggagacacagcuugggauuucggcuccgucgggggaguguuuaacucucucggcaaggggauucaccagaucuucggcgccgccuuuaagagccuguucggaggcauguccugguuuucucaaauccugauugggacccuucucguguggcugggacugaauaccaaaaacggcagcaucucccucacaugucuggcucuugggggaguuaugauuuuccugagcacggcggugucugccgacgucggcugcuccguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4560 - RNA, 2359 nt, Artificial Sequence
  KU955595.1 prME-long mRNA Design 1 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacacggcgggugugugaccgugauggcccaggauaaacccacagucgacaucgagcuugugaccaccacaguuagcaacauggcugaggugagaucuuacugcuacgaagccuccaucagcgauauggcuuccgacucucgguguccuacgcaaggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucagcccgaaaaccucgaguaucggaucaugcuguccgugcacggcagccaacauucugggaugauugucaaugauacgggacacgaaacagacgagaacagagcuaagguggaggucaccccuaauagcccgcgcgcggaagccacccuuggcggcuucgggucccugggacucgauugugagccccggacaggccuggacuuuucugaucuuuacuaucugaccaugaacaauaaacauuggcucgugcacaaggaaugguuccacgacaucccucugcccuggcaugcuggggccgauacaggaacgccucacuggaacaauaaagaggcccugguugaauuuaaggacgcucaugccaagagacagaccguggucgugcucggcagccaggagggggcgguucacacagcucuggccggcgcccuugaggcugaaauggauggagccaaaggccgccuguucuccgggcaucucaagugccggcugaaaauggacaaacuuagacugaagggagugagcuacucucucuguaccgcugccuuuacauucaccaagguccccgcggagacgcugcacggcaccgugacaguggaaguucaguaugccgggaccgacggaccgugcaaggucccugcucaaauggccguggauaugcagacacugacccccgugggccgccucauuacggcuaacccugucaucacagaguccaccgaaaacagcaaaaugaugcuggagcuugacccucccuuuggggauucuuacaucgugauuggcguuggagacaagaaaaucacacaccauuggcaccgguccggcagcaccauugggaaggccuucgaggcgaccgugagaggagccaaacgcauggcuguccugggcgauacagccugggacuucggguccgugggaggcguuuuuaauucucucgggaagggcauccaucagauuuucggagcugccuuuaagagccuguucggcgggauguccugguuuucucaaauccugaucggaacgcuucucguguggcugggccugaacaccaaaaaugggagcauuucccucacaugucuggcccuuggaggcgucaugaucuuccugagcaccgcugugucugcggauguugggugcuccguggacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4561 - RNA, 2359 nt, Artificial Sequence
  KF383116.1 prME-long mRNA Design 1 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaacacaagaaaggcgaagcccgcagaagccggcgcgcgguuacccuuccgucccauucuacaagaaagcugcagacccggagccagacauggcucgagucccgcgaguauaccaagcaccugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacauggcgggugugugaccgugauggcccaagauaaacccacagucgacaucgagcuugugaccaccacaguuagcaacauggcugaggugagaucuuacugcuacgaagccuccaucagcgauauggcuuccgacucucgguguccuacgcagggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucaacccgaaaaccucgaguaucggaucaugcuguccgugcacggcagccagcacucugggaugauugucaaugauaucggacaugaaacggacgagaacagagcuaagguggaggucacaccuaauagcccgcgcgcggaagccacccuuggcggcuucgggucccugggacucgauugugagccccggaccggccuggacuuuucugaucuuuacuaucugacaaugaacaauaaacacuggcucgugcauaaggaaugguuccacgacauuccucugcccuggcacgcuggggccgauaccggaacaccucauuggaacaauaaagaggcccugguugaauuuaaggacgcucacgccaagagacagacgguggucgugcucggcagccaggagggggcgguucauaccgcucuggccggcgcccuugaggcugaaauggauggagccaaaggccgccuguucuccgggcaccucaagugccggcugaaaauggacaaacuuagacugaaaggagugagcuacucucucuguacagcugucugcaccgccgcgaaggugcccgccgagacacugcauggcaccgugacgguugaaguccaauaugcugggaccgacggaccguguaaggugccugcccagauggcuguggauaugcagacacugacccccgucggccgccucaucacagccaacccugugaucaccgaguccacggaaaacagcaaaaugaugcuggagcuugacccucccuuuggggauucuuacauuguuaucggcgugggagacaagaaaauuacacaccacuggcaucgguccggcagcaccaucgggaaggcguucgaggccacagucagaggagcuaaacgcauggccgugcugggcgauaccgcuugggacuuuggguccguuggaggcguguucaauucucucgggaagggcauucaccaaaucuucggagccgccuuuaagagccuguucggcgggauguccugguuuucucagauccugauuggaacccuucucgucuggcugggccugaacacaaagaaugggagcaucucccucacgugccuggcucuuggaggcgugaugauuuuccugagcaccgcgguuucugccgaugugggguguuccgucgacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4562 - RNA, 2341 nt, Artificial Sequence
  KU963574.2 prME-long mRNA Design 1 opt
gggagaaagcuuaccaugagaaucauuaacgcccggaaggagcgcaaaagacggggcgcugacgccagcaucgggauugugucccugcuccugaccacagucauggcggcugaaaucacgcgcagaggaucugccuacuauauguaccuugaucggagcgacgccggcaaggcuauuuccuucguuaccacacugggggugaauaaaugccacgugcagaucauggaucucggacauaugugugacgccaccaugucuuaugagugccccaugcuggaugaaggcgucgagcccgacgauguggacuguuggugcaacacaaccagcacauggguuguguacgggaccugucaccauaagaaaggagaagcucgcagaucccggcgcgccgucacgcuuccgucucacagcaccagaaagcugcaaacacggucccagaccuggcucgagagccgcgaguauacaaagcaucugaucaaaguggaaaauuggauuuuuagaaaccccggcuucgcgcugguugccguggcuaucgccuggcuccugggaucuuccaccagccagaaggucauuuaccuugugaugauccugcucauugcuccugccuauucuauccggugcauugggguguccaaucgcgauuuugucgagggaaugagcggcgggacguggguugacguggugcuggaacacggaggcugugucacagugauggcgcaggauaaacccaccguugacaucgagcuugugacaaccaccgucucuaacauggccgaggugagauccuacugcuacgaagcuagcaucuccgauauggccucugacagccgguguccuacacaaggggaggcuuaucuggacaagcaguccgauacgcaguacguuugcaaaagaacccucguggaccgcggauggggcaauggcugugggcuguucggaaagggcagccuggucacaugcgccaaguuuaccugcucuaaaaagaugacagggaaauccauucagcccgaaaaccucgaguaucggaucaugcugagcgugcacggaucucaacauagcggcaugauugucaaugaugaaaacagagccaagguggagguuaccccuaauuccccgcgcgcugaggcgacgcuugggggauucggcucucugggccucgacugugaaccccggacagggcuggauuuuagcgaccuuuacuaucugaccaugaacaauaaacacuggcucgugcauaaggagugguuccacgauaucccucugcccuggcacuccggagccgacaccgaaacaccucauuggaacaauaaagaggcucuggucgaauuuaaggaugcccacgccaagagacagaccgugguugugcucggcagccaggagggggcuguccauacagcccuggcgggagcucuugaggccgaaauggacggcgccaaagggcgccugucuuccggccaccucaagugccggcugaaaauggauaaacuuagacugaaaggagugagcuacucucucuguacggcugccuucaccuuuacaaaggugcccgcugagacccugcauggcacaguuaccgucgaagugcaguaugccgggcgcgacggaccgugcaaggugccugcgcaaauggccgucgacaugcagacgcugacccccgugggccggcucauuacagcuaacccuguuaucaccgaguccacagaaaacagcaaaaugaugcuggagcuugauccucccuucggggacuccuacaucgugauuggagucggcgauaagaaaaucacccaccacuggcauagaucugggagcauuaucggcaaggccuuugaggcuacggugcgcggagccaaacggauggcgguucugggcgacacagccugggauuucggguccgugggaggcgucuucaauucucucgggaagggcauucaccagaucuuuggcgcugccuucaagagccuguuugggggcauguccugguucagccaaauccugauuggaacccuucucguguggcugggccugaacacaaagaaugggucuaucucccucaccugucuggcucuuggaggcguuaugauuuuucugagcaccgccgugucugccgacgucgggugcuccguggauuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4563 - RNA, 2341 nt, Artificial Sequence
  KX601166.1 prME-long mRNA Design 1 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacacggcgggugugugaccgugauggcccaggauaaacccacagucgacaucgagcuugugaccaccacaguuagcaacauggcugaggugagaucuuacugcuacgaagccuccaucagcgauauggcuuccgacucucgguguccuacgcaaggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucagcccgaaaaccucgaguaucggaucaugcuguccgugcacggcagccaacauucugggaugauugucaaugaugaaaacagagcuaagguggaggucacgccuaauagcccgcgcgcggaggccacacuuggaggcuucggcucccuggggcucgacugugaaccccggaccggacuggauuuuucugaccuuuacuaucugaccaugaacaauaaacacuggcucgugcauaaggagugguuccacgauaucccucugcccuggcacgcuggcgccgacacagggaccccucauuggaacaauaaagaagcccugguugaguuuaaggaugcucacgccaagagacagacaguggucgugcucggaagccaggaaggcgcgguucauacggcucuggccggggcccuugaggcugagauggacggcgccaaaggacgccuguucuccggccaccucaagugccggcugaaaauggauaaacuuagacugaaaggggugagcuacucucucuguaccgcugccuuuacauucaccaagguccccgcggaaacacugcauggaaccgugacgguggagguucaguaugccggcaccgacgggccgugcaaggucccugcucaaauggccguggacaugcagacacugacccccgugggacgccucauuacagcuaacccugucaucaccgaauccacggagaacagcaaaaugaugcuggaacuugauccucccuuuggcgacucuuacaucgugauugggguuggcgauaagaaaaucacacaccacuggcaucgguccggaagcaccauuggcaaggccuucgaggcgacagugagaggggccaaacgcauggcuguccugggagacaccgccugggauuucggcuccguugggggaguguuuaauucucucggcaaggggauccaccagauuuucggcgcugccuuuaagagccuguucggaggcauguccugguuuucucaaauccugaucgggacccuucucguguggcugggacugaacacaaagaauggcagcauuucccucacgugucuggcccuugggggagucaugaucuuccugagcaccgcugugucugcggacguuggcugcuccguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4564 - RNA, 2359 nt, Artificial Sequence
  KF383118.1 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagccugacgauguggacuguuggugcaacaccacaucuaccuggguggucuacggaacgugucaccauaagaaaggcgaaacccgcagaagccggcgcuccgugucucuuagauaucacuacacacggaagcugcaaacccgcagccagacauggcucgaguccagagaguauaagaaacaucugauuaugguugaaaauuggaucuuucggaacccgggcuucgccauugugagcgucgcgaucaccuggcugauggggucucucacgucccagaaggugauuuaccugguuaugaucgugcuuauuguccccgccuacagcaucucuugcaucggaguguccaaucgcgaucugguggagggcaugagcgggggaacaugggucgacguugugcucgaacacggcgggugugugaccgagauggcucaggauaaaccuacagucgacauugagcuggugaccaugaccguuucuaacauggccgaagugagauccuauugcuacgaggcuagccuuuccgauauggccucugcgagccggugucccacacaaggagaaccuucccuggacaagcagagcgacacgcagucugucugcaaaagaacccucggcgaucgcggcugggggaauggauguggcaucuuugggaagggaucccuggugacaugcagcaaguuuaccugcuguaaaaagaugcccggcaaaucuauucagccugagaaccuggaauaucggaucaugcucccgguucacgggagccaacauuccggaaugauugugaaugacaucggccacgagacagaugagaacagagccaaggucgaagugacccccaauucuccucgcgcugaggccacgcugggcggguuuggaagccuuggccuggacugcgaaccccggacagggcucgauuucuccgaccuguacuaucuuaccaugaacaauaaacauuggcugguccacaaggagugguuucacgauaucccucuccccuggcaugcuggagccgacaccggcacaccgcacuggaacaauaaagaagcccugguggaguucaaggaugcucaugcgaagagacagaccguugugguccuggggagccaggagggcgccgugcacacagcucucgccggagcccuggaagcugagauggacggcgccaaagggcgccuuuucucuggacaucugaagugucggcucaaaauggauaagcugagacuuaaaggcguuuccuacagccugugcacggcggcuuucaccuuuacaaaggugccugccgaaacccuccacgggacagucaccguggaggugcagucugccggaacggacggccccuguaagguuccugcucaaauggccgucgacaugcagacccugacacccguggggcgccugauuaccgcuaaccccgugaucacagaauccaccgagaacagcaaaaugaugcucgagcuggauccuccguucggcgacuccuauauugucaucggagugggcgauaagaaaauuacgcaccauuggcaccggucugggagcacaaucggaaaggccuuugaagcgaccguuagaggcgccaaacgcauggcugugcuuggggacacagccugggauuucggauccgucggcgggguguucaauucucugggcaagggaauccaucagauuuuuggcgcugccuucaagagccucuuugggggaauguccugguucagccaaauccugauuggcacccugcuuguuuggcucgggcugaacaccaaaaauggaucuaucucccugacaugccucgcgcugggcggggugaugauuuuucuuagcacggccgucucugcugacgugggcuguuccguugauuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4565 - RNA, 2353 nt, Artificial Sequence
  KF383120.1 prME-long mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaccaugggagugaauaaaugccacguccagaucauggaucugggccauaugugugacgcuacaauguccuaugagugccccaugcucgaugaagggguugagccugacgauguggacuguuggugcaacaccacaucuaccuggguggucuacggaacgugucaccauaagaaaggcgaagcccgcccgagcagacgggcggugacccugcccucccacucuacacgcaaacuucaaaccagaagccagacauggcuggagucccgggaguauaccaagcaucucauuaagguugaaaauuggauccugcgcaacccuggcuuuacgguggccgcucuggccauggcuuggcuccuggggaauagcacaucucagagagucauuuaccuugugaugauccugcucauugcccccgcguauuccauccggugcauuggaguuagcaaccgcgauuucguggagggcaugucugggggaaccugggucgacguggugcuggaacacggcgggugugucacaguuauggcccaggauaagccuaccguggacaucgagcuugugaccacaacggucuccaauauggcugaggugagaagcuacugcuacgaagccucuaucuccgauauggcuagcgacucccggugucccacccaaggagaggccuaucuggacaaacagucugauacacaguacguuugcaagagaacccucguggaccgcggcuggggcaacggguguggacuguuuggcaaagggagccuggucacaugcgccaaguuuaccugcuccaagaaaaugacgggaaagagcauucagccugaaaaucucgaguaucggaucaugcugucugugcacggcucccaacauagcgggaugauuguuaacgauaucggacacgaaacagacgagaauagagcuaaaguggaggucaccccgaacucuccccgcgcggaagccacccuuggcggcuucgggagccugggacucgauugugagccucggacaggccuggacuucuccgaucuuuacuaucugaccaugaauaacaagcauuggcucgugcacaaagaaugguuucacgacauuccccugccuuggcaugcuggggccgauacaggaacgccccacuggaauaacaaggaggcccuggucgaguucaaagacgcucaugccaagagacagaccgugguugugcucggcucucaggaaggggcgguccacacagcucuggccggcgcccuugaggcugaaauggauggagccaagggccgccuguuuagcgggcaucucaaaugccggaucaagauggacaaacugagacuuaagggaguguccuacagccuguguaccgcugccuucacauuuucuaaaguuccggcggagacccuccacggcacggugaccgucgaagugcaguaugccgggcgcgacggaccuugcaaggugcccgcucaaauggccguugauaugcagacacugaccccugucggccggcugaucacagcuaaccccauuaucaccgaguccacggaaaauagcagaaugaugcucgagcuggaucccccuuucggggacucuuacauugugaucggcgugggagacaagaaaauuacacaccauuggcaccgcuccggcagcaccaucgggaaggccuuugaggcgacaguccggggagccaaaagaauggcugugcuuggcgauaccgccugggacuucggguccguuggaggcguguucaacucucuggggaagggcguccaucagguguuuggagcugccuucaaaagccucuuuggcgggauguccugguucucucaaauccugauuggaacccugcuuguuuggcucggccugaauacaaagaacgggagcaucucccuggccugucucgcucugggaggcgcgaugauuuuucuuagcacggccgugucugcugaugucgggugcuccguggacuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4566 - RNA, 2284 nt, Artificial Sequence; identical to SEQ ID NO: 4401
  KU321639.1 prME-short mRNA Design 1 opt

SEQ ID NO: 4567 - RNA, 2284 nt, Artificial Sequence; identical to SEQ ID NO: 4402
  KU312312.1 prME-short mRNA Design 1 opt

SEQ ID NO: 4568 - RNA, 2272 nt, Artificial Sequence; identical to SEQ ID NO: 4403
  AY632535.2 prME-short mRNA Design 1 opt

SEQ ID NO: 4569 - RNA, 2284 nt, Artificial Sequence; identical to SEQ ID NO: 4404
  KU527068.1 prME-short mRNA Design 1 opt

SEQ ID NO: 4570 - RNA, 2284 nt, Artificial Sequence
  KX421193.1 prME-short mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucgugaacgacacgggguacgagacagaugaaaauagagccaaggucgaggugaccccuaacagcccgcgggccgaggcuacccuuggaggcuucggcucccuggggcucgacugugaacccagaacaggacuggauuuuucugaccuuuauuaccugaccaugaauaacaaacacuggcucguccauaaggagugguuccacgauauuccucugcccuggcacgcgggcgccgacacagggacgccucauuggaauaacaaagaagcucugguggaguuuaaggaugcccacgccaaacgccagaccguugugguccucggaagccaggaaggcgcugugcauacagcccuggcgggggcucuugaggccgagauggacggcgccaagggaaagcuguucuccggccaccucaaaugccggcugaagauggauaaacuuagacugaaggggguuagcuauucucucuguaccgcugccuuuacauucaccaaagugcccgcugaaacgcugcauggaaccgucacaguggaggugcaguacgccggcaccgacgggccgugcaagaucccuguucaaauggcggucgacaugcagacacugacccccgugggacgccucauuacggccaauccugugaucacagaauccaccgagaacagcaagaugaugcuggaacuugauccucccuuuggcgacucuuacaucgucauuggggugggcgauaaaaagaucacacaccacuggcaucgguccggaagcaccauuggcaaggcuuucgaggccaccguuagaggggcuaaacgcauggccgugcugggagacacagcgugggauuucggcuccgucgggggaguguuuaacucucucggcaaagggauccaccagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4571 - RNA, 2284 nt, Artificial Sequence
  KX377335.1 prME-short mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucacagaaagaaaggagaggcccggcgcagcagacgggcugugacccuuccgucccauucuacacgcaagcugcaaaccagaagccagacauggcucgaaucccgggaguauaccaaacaccugaucaagguugagaacuggaucuuucgcaaucccggcuucgcccugguggcggucgccauugcuuggcuccugggcagcucuacgucccagaaggugaucuaccuuguuaugauucugcucaucgccccugcuuauagcauuagaugcaucggggugucuaaccgggacuuugucgaaggaauguccggcgggacauggguggaugugguccuggagcauggaggcuguguuaccgugauggcccaggacaaacccacaguggauauugaacuugucaccaccacagugagcaauauggcggagguucgcucuuacugcuacgaggccuccaucagcgacauggcuuccgauucuagauguccuacgcaaggggaagccuaucuggacaagcagagcgacacccaguacgugugcaaacggacacucgucgaucgcggauggggcaacggcugugggcuguucggaaagggcucccuggugaccugcgcuaaauuuacaugcagcaagaagaugaccgggaaaucuauccagcccgagaaucucgaauauagaauuaugcuguccguucacggaagccaacacucuggcaugaucgugaacgacacgggguacgagacagaugaaaaucgggccaaggucgaggugaccccuaacagcccgagagccgaggcuacccuuggaggcuucggcucccuggggcucgacugugaaccccgcacaggacuggauuuuucugaccuuuauuaccugaccaugaauaacaaacauuggcucguccacaaggagugguuccaugauauuccucugcccuggcacgcgggcgccgacacagggacgccucacuggaauaacaaagaagcucugguggaguuuaaggaugcccaugccaaacggcagaccguugugguccucggaagccaggaaggcgcugugcacacagcccuggcgggggcucuugaggccgagauggacggcgccaagggaaagcuguucuccggccaucucaaaugcagacugaagauggauaaacuucgccugaaggggguuagcuauucucucuguaccgcugccuuuacauucaccaaagugcccgcugaaacgcugcacggaaccgucacaguggaggugcaguacgccggcaccgacgggccgugcaagaucccuguucaaauggcggucgacaugcagacacugacccccgugggacggcucauuacggccaauccugugaucacagaauccaccgagaacagcaagaugaugcuggaacuugauccucccuuuggcgacucuuacaucgucauuggggugggcgauaaaaagaucacacaucacuggcacagauccggaagcaccauuggcaaggcuuucgaggccaccguucgcggggcuaaacggauggccgugcugggagacacagcgugggauuucggcuccgucgggggaguguuuaacucucucggcaaagggauccaucagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4572 - RNA, 2284 nt, Artificial Sequence
  LC002520.1 prME-short mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugacggugaacgacaucggguacgagacagaugaaaauagagccaaggucgaggugaccccuaacagcccgcgggccgaggcuacccuuggaggcuucggcucccuggggcucgacugugaacccagaacaggacuggauuuuucugaccuuuauuaccugaccaugaauaacaaacacuggcucguccauaaggagugguuccacgauauuccucugcccuggcacgcgggcgccgacacagggacgccucauuggaauaacaaagaagcucugguggaguuuaaggaugcccacgccaaacgccagaccguugugguccucggaagccaggaaggcgcugugcauacagcccuggcgggggcucuugaggccgagauggacggcgccaagggaaagcuguucuccggccaccucaaaugccggcugaagauggauaaacuuagacugaaggggguuagcuauucucucuguaccgcugccuuuacauucaccaaagugcccgcugaaacgcugcauggaaccgucacaguggaggugcaguacgccggcaccgacgggccgugcaagaucccuguucaaauggcggucgacaugcagacacugacccccgugggacgccucauuacggccaauccugugaucacagaauccaccgagaacagcaagaugaugcuggaacuugauccucccuuuggcgacucuuacaucgucauuggggugggcgauaaaaagaucacacaccacuggcaucgguccggaagcaccauuggcaaggcuuucgaggccaccguuagaggggcuaaacgcauggccgugcugggagacacagcgugggauuucggcuccgucgggggaguguuuaacucucucggcaaagggauccaccagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4573 - RNA, 2266 nt, Artificial Sequence
  DQ859059.1 prME-short mRNA Design 1 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucacgcuggucgccguggcgaucgccuggcuccugggcagcucuacaucccagaagguuauuuaccuugugaugauccugcucauugcuccugccuauagcauccgcugcauuggggucucuaacagagacuuuguggaaggaauguccggcgggaccuggguggaugucguucuggagcacggaggcugugugacagugauggcucaggacaaacccaccgucgauaucgaacuugugaccacaacgguuagcaauauggccgaggugcggucuuacugcuacgaggcguccauuagcgacauggccuccgauucucgcuguccuacccaaggggaggcuuaucuggacaagcagagcgacacacaguacgucugcaaaagaacccucguggaucggggauggggcaacggcugugggcuguucggaaagggcucccugguuacaugcgccaaauuuaccugcagcaagaagaugacggggaaaucuauccagcccgaaaaucucgaauaucgcaucaugcuguccgugcacggaagccaacauucuggcaugauugucaacgacgagaauagagcuaagguggaagucacaccuaacagcccgcgggccgaggccacccuugggggauucggcucccugggccucgauugugagcccagaaccgggcuggacuuuucugaucuuuacuaucugacaaugaauaacaaacacuggcucgugcauaaggaaugguuccacgacaucccucugcccuggcacgcuggagcggauaccggcacaccucauuggaauaacaaagaggcccugguugaauuuaaggacgcucacgccaaacgccagacgguggucgugcucgggagccaggagggagccguucauaccgcucuggccggcgcgcuugaagcugagauggauggggccaagggccggcuguucuccggacaccucaagugcagacugaaaauggacaaacuucgccugaagggcgugagcuacucucucuguacagccgcuuuuaccuucacaaagguccccgccgagacccugcaugggacggugaccguggaaguucaguaugcuggaacagauggcccgugcaaagucccugcccaaauggcgguggacaugcagacccugacacccguggggcggcucauuaccgccaauccugucaucacggaguccacagaaaacagcaagaugaugcuggagcuugacccucccuuuggagauucuuacauugugaucggcguuggggacaagaaaaucacccaccacuggcauagauccggcagcacaauuggaaaggcuuucgaagccaccgugcgcggcgcuaaacggauggccguccugggggauaccgcgugggacuucggauccgugggcgggguuuuuaacucucucggaaagggcauccaccagauuuucggggccgcuuuuaaaagccuguucggcggaauguccugguuuucucaaauccugauuggcacacuucucguguggcuggggcugaauacgaagaacggaagcaucucccucaccugucuggcccuuggcggggucaugaucuuccugagcacagcugugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4574 - RNA, 2272 nt, Artificial Sequence
  KU963573.2 prME-short mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaaaacagagccaagguggaggucacaccuaauagcccgcgggccgaggcuacccuuggaggcuucggcucccuggggcucgauugugaacccagaaccggacuggacuuuucugaucuuuauuaccugacaaugaacaauaaacacuggcucgugcauaaggagugguuccacgacauuccucugcccuggcacgcgggcgccgauaccgggacaccucauuggaacaauaaagaagcucuggucgaguuuaaggacgcccacgccaaacgccagacggugguugugcucggaagccaggaaggcgcuguccauaccgcccuggcgggggcucuugaggccgagauggauggcgccaagggaaagcuguucuccggccaccucaaaugccggcugaagauggacaaacuuagacugaagggggugagcuauucucucuguacagcugccuuuaccuucacaaaaguucccgcugaaacccugcauggaacggugaccgucgaggugcaguacgccggcacagaugggccgugcaagaucccugugcaaauggcgguugacaugcagacccugacacccgucggacgccucauuaccgccaacccugugaucacggaauccacagagaauagcaagaugaugcuggaacuugacccucccuuuggcgauucuuacaucgugauuggggucggcgacaaaaagaucacccaccacuggcaucgguccggaagcacaauuggcaaggcuuucgaggccaccgugagaggggcuaaacgcauggccguucugggagauaccgcgugggacuucggcuccgucgggggaguguuuaacucucucggcaaagggauccaccagauuuucggcgccgcuuuuaagagccuguucggaggcauguccugguuuucucaaauccugaucgggacacuucucguguggcugggacugaacacgaagaauggcagcauuucccucaccugucuggcccuugggggaguuaugaucuuccugagcacagcugugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4575 - RNA, 2284 nt, Artificial Sequence
  KX694534.2 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggccgcgggauucaccagaucuucggcgccgccuuuaagagccuguucggaggcauguccugguuuucucaaauucuuaucgggacacuccugauguggcugggacucaacacgaaaaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4576 - RNA, 2284 nt, Artificial Sequence
  KX369547.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggccuggcucucgccgcggccgcuaucgccuggcugcuuggcuccagcacgucucagaaagucaucuaucuggugaugauucuccugaucgcucccgccuacuccauuagaugcaucgggguuagcaaucgggacuucguggagggaaugucuggcgggacaugggucgauguggugcuugaacauggaggcugugucaccguuauggcgcaggacaagccuacaguggauauugagcuggugaccaccacagucuccaacauggccgaggugcgcagcuacugcuaugaagcuagcaucuccgacauggccagcgauuccagaugucccacgcaaggggaggcuuaccucgacaagcagucugacacccaguauguuugcaaacggacacugguggaucgcggauggggcaauggcugugggcuguuuggaaagggcagccucgugaccugcgccaaauucgccugcuccaagaaaaugacagggaagucuauucagccugaaaaccuggaguacagaaucaugcuuucugugcacggaucccaacacagcggcaugaucguuaaugacaccgggcaugaaacggaugagaaccgggcuaagguggagauuacacccaauucuccgagagcggaagccacccugggaggcuuuggcagccucgggcuggacugugagccucgcaccggacuugauuucuccgaccuguauuaccucacaaugaacaauaaacacuggcugguccauaaggaaugguuucacgauaucccccugccuuggcacgcuggcgccgacaccgggacaccccauuggaacaauaaagaggcccucguggaguucaaggaugcucacgccaaacggcagacggucgugguucugggaucucaggaaggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuuuaccuucacaaagauuccggcggagacccugcauggaacggugaccguugaagugcaguacgccggcacagacgggccuugcaaaguccccgcucaaauggccguggacaugcagacccucacaccugugggaagacugaucaccgcuaaccccguuauuacggaguccacagaaaacagcaagaugaugcuugagcuggaucccccuuuuggcgacucuuacaucgucaucggggugggcgagaaaaagauuacccaccacuggcaucgcuccggaagcacaaucggcaaggccuucgaagcgaccgugagaggggccaaacggauggcuguccucggagauaccgccugggacuuuggcuccgucgggggagcucuuaauucucugggcaaggggauucaccagaucuucggcgccgccuucaaaagccuguuuggaggcauguccugguucucucaaauucucaucgggacacugcugauguggcucggacugaacacgaagaauggcagcaucucccuuaugugucuggcucucgggggaguucugauuuuucugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4577 - RNA, 2284 nt, Artificial Sequence
  KX447515.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacugguaucgcuccggaagcacaaucggcaaggccuuugaagcgaccgugagaggggccaaacggauggcuguccugggagauaccgccugggacuucggcuccgucgggggagcucucaauucucugggcaaggggauucaucagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4578 - RNA, 2284 nt, Artificial Sequence
  KU729218.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacacccagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccgucgggggagcucucaauucucugggcaaggggauucaccagaucuucggcgccgccuuuaaaagccuguucggaggcauguccugguuuucucaaauucuuaucgggacgcuccugauguggcugggacucaacaccaagaauggcagcaucucccugaugugucuugcucuugggggaguucucauuuuccugagcacagcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4579 - RNA, 2284 nt, Artificial Sequence
  KU501217.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgagauccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4580 - RNA, 2284 nt, Artificial Sequence
  KU312314.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccuggcucaaauggccguggacaugcagacccucacacccgugggaagacugaucaccgcuaacccuguuauuacggaguccacagaaaacagcaagaugaugcuugagcuggauccgcccuucggcgacucuuacaucgucaucggggugggcgagaaaaagauuacccaccacuggcaucgcuccggaagcacaaucggcaaggccuuugaagcgaccgugagaggggccaaacggauggcuguccucggagauaccgccugggacuucggcuccgucgggggagcucuuaauucucugggcaaggggauucaccagaucuucggcgccgccuuuaaaagccuuuucggaggcauguccugguuuucucaaauucucaucgggacacugcugauguggcucggacugaacacgaagaauggcagcaucucccuuaugugucuggcucucgggggaguucugauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4581 - RNA, 2284 nt, Artificial Sequence
  KX446950.2 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuacccuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaauucucugggcaaggggauucaccagaucuucggcgccgccuuuaaaagccuguucggaggcauguccugguuuucucaaauucuuaucgggacgcuccugauguggcugggacucaacaccaagaauggcagcaucucccugaugugucuugcucuugggggagugcucauuuuccugagcacagcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4582 - RNA, 2284 nt, Artificial Sequence
  KY003157.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccguggucucugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4583 - RNA, 2284 nt, Artificial Sequence
  KX811222.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccgcuugggucguguaugggaccugucaucacaaaaagggagaagccagacggucucgcagagcuguuacgcuucccagccauuccacccggaaacugcaaacacgcccucagaccuggcucgagucuagagaguacacaaagcaccugauccggguggaaaauuggauuuuucgcaaccccggcuucgcccuggcggccgcugccaucgcuuggcuccugggcagcuccaccagccagaaagucaucuaucuugugaugauucugcucaucgccccugcguacucuauuagaugcaucgggguuuccaaucgggacuuuguggagggaaugagcggcgggacgugggucgauguggugcuggaacauggaggcugugucacaguuauggcccaggacaagcccaccguggauauugagcuugugacaaccaccgucucuaacauggcugaggugcgcuccuacugcuaugaagccagcaucucugacauggcuuccgauagcagauguccuacacaaggggaggccuaccuggacaagcaguccgacacgcaguauguuugcaaacggacccucguggaucgcggauggggcaauggcugugggcuguucggaaagggcucucuggucacaugcgccaaauuugcuugcagcaagaaaaugaccgggaaguccauucagccggaaaaccucgaguacagaaucaugcugagcgugcacggaucucaacacuccggcaugaucguuaaugacacagggcaugaaaccgaugagaaccgggcgaagguggagauuacgcccaauagcccuagagccgaagcuacacuuggaggcuucggcucucuggggcucgacugugagccccgcaccggacuggauuuuagcgaccuuuauuaccugaccaugaacaauaaacacuggcucguccauaaggaaugguuccacgauaucccucugcccuggcacgccggcgccgacacagggaccccgcauuggaacaauaaagaggcucugguggaauuuaaggaugcccacgcgaaacggcagacagucgugguucucggaucccaggagggcgcugugcauacggcccuggccggggcucuugaggccgaaauggacggcgcuaagggaagacugucuagcggccaccucaaaugccgccugaagauggauaagcugcggcugaaaggggucuccuauagccucuguaccgccgcguucacauuuaccaagauuccugccgagacacugcauggaaccgugacgguugaagugcaguacgcuggcaccgacgggcccugcaaagucccugcccaaauggcuguggacaugcagacacugacccccgugggaagacucaucacagccaaccccguuauuaccgagucuacggaaaacuccaagaugaugcuggagcuugauccuccguucggcgacagcuacaucgucaucggggugggcgagaaaaagauuacacaccacuggcaucgcucuggauccaccaucggcaaggcguuugaagccacagugagaggggcuaaacggauggccguccugggagauaccgcuugggacuucggcagcguugggggagcccucaauucccugggcaaggggauucaccagaucuucggcgccgcuuuuaaaucucuguucggaggcaugagcugguuuucccaaauucuuaucgggacccuccugauguggcugggacucaacacaaagaauggcucuaucagccugaugugucuugcgcuugggggagugcucauuuuccuguccacggccgugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4584 - RNA, 2284 nt, Artificial Sequence
  KX447516.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucuaaaaaggucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcagggggaggcuuaccuggacaaacaaucugacacccaguauguuugcaagcggacacucguggaucgcggauggggcaauggcugugggcuguucggaaaaggcagccuggugaccugcgccaaguuugccugcuccaaaaagaugacagggaagucuauucagccugaaaaccucgaguacagaaucaugcugucugugcacggaucccagcacagcggcaugaucguuaaugacaccgggcaugaaacggaugagaaccgggcuaaaguggagauuacacccaauucuccgagagcggaagccacccuuggaggcuucggcagccuggggcucgacugugagccucgcaccggacuggauuuuuccgaccuuuauuaccugacaaugaacaauaagcacuggcucguccauaaagaaugguuccacgauaucccccugccuuggcacgcuggcgccgacaccgggacaccccauuggaacaauaaggaggcccugguggaauuuaaagaugcucacgccaagcggcaaacggucgugguucucggaucucaggagggcgcggugcauaccgcucuggccggggcccuugaggcugaaauggacggcgccaaaggaagacugagcuccggccaccucaagugccgccugaagauggauaaacuucggcugaagggggucagcuauucucucuguacagcugccuucaccuuuacaaaaauuccggcggagacccugcauggaacggugaccguugaagugcaguacgccggcacagacgggccuugcaagguccccgcucagauggccguggacaugcaaacccugacaccugugggaagacucaucaccgcuaaccccguuauuacggaguccacagaaaacagcaaaaugaugcuggagcuugaucccccuuucggcgacucuuacaucgucaucggggugggcgagaagaagauuacccaccacuggcaucgcuccggaagcacaaucggcaaagccuuugaagcgaccgugagaggggccaagcggauggcuguccugggagauaccgccugggacuucggcuccgucgggggagcucucaauucucugggcaaagggauucaccagaucuucggcgccgccuuuaagagccuguucggaggcauguccugguuuucucagauucuuaucgggacacuccugauguggcugggacucaacacgaaaaauggcagcaucucccugaugugucuugcucucgggggaguucugauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4585 - RNA, 2284 nt, Artificial Sequence
  KX520666.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgagacagaaagucaucuaucuugugaugauucugcucaucgcucccgccuacucuauucggugcaucgggguuuccaaucgcgacuuuguggagggaaugagcggcgggacaugggucgauguggugcuggaacauggaggcugugucaccguuauggcgcaggacaagccuacaguggauauugagcuugugaccaccacagucucuaacauggccgaggugagauccuacugcuaugaagcuagcaucucugacauggccuccgauagccggugucccacgcaaggggaggcuuaccuggacaagcaguccgacacccaguauguuugcaaacgcacacucguggauagaggauggggcaauggcugugggcuguucggaaagggcucucuggugaccugcgccaaauuugccugcagcaagaaaaugacagggaaguccauucagccugaaaaccucgaguaccggaucaugcugagcgugcacggaucucaacacuccggcaugaucguuaaugacaccgggcaugaaacggaugagaacagagcuaagguggagauuacaccgaauagcccccgcgcggaagccacccuuggaggcuucggcucucuggggcucgacugugagccucggaccggacuggauuuuagcgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaaagacagacggucgugguucucggaucccaggagggcgcggugcauaccgcucuggccggggcccuugaggcugaaauggacggcgccaagggacgccugucuagcggccaccucaaaugccggcugaagauggauaagcugagacugaaaggggucuccuauagccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggacgccucaucaccgcuaaccccguuauuacggagucuacagaaaacuccaagaugaugcuggagcuugaucccccuuucggcgacagcuacaucgucaucggggugggcgagaaaaagauuacccaccacuggcaucggucuggauccacaaucggcaaggccuuugaagcgaccgugagaggggccaaacgcauggcuguccugggagauaccgccugggacuucggcagcgucgggggagcucucaauucccugggcaaggggauucaccagaucuucggcgccgccuuuaaaucucuguucggaggcaugagcugguuuucccaaauucuuaucgggacacuccugauguggcugggacucaacacgaagaauggcucuaucagccugaugugucuugcucuugggggaguucucauuuuccuguccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4586 - RNA, 2284 nt, Artificial Sequence
  KU497555.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaacccaggagggcgcggugcauacagcucuggccggggcccuugaggcugaaauggacggcgccaagggaagacugucuagcggccaccucaaaugccgccugaagauggauaagcugcggcugaaaggggucuccuauagccucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagagucuaccgaaaacuccaagaugaugcuggagcuugaucccccuuucggcgacagcuacaucgucaucggggugggcgagaaaaagauuacacaccacuggcaucgcucuggauccaccaucggcaaggccuuugaagcgaccgugagaggggccaaacggauggcuguccugggagauacagccugggacuucggcagcgucgggggagcucucaauucccugggcaaggggauucaccagaucuucggcgccgccuuuaaaucucuguucggaggcaugagcugguuuucccaaauucuuaucgggacgcuccugauguggcugggacucaacaccaagaauggcucuaucagccugaugugucuugcucuugggggaguucucauuuuccuguccacagcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4587 - RNA, 2284 nt, Artificial Sequence
  KY075939.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacucccugagaugcauugggguuagcaaucgggacuuuguggagggaaugucuggcgggacaugggucgauguggugcuugaacauggaggcugugucaccguuauggcgcaggacaagccuacaguggauaucgagcuggugaccaccacagucuccaacauggccgaggugcgcagcuacugcuaugaagcuagcauuuccgacauggccagcgauuccagaugucccacgcaaggggaggcuuaccucgacaagcagucugacacccaguauguuugcaaacggacacugguggaucgcggauggggcaauggcugugggcuguucggaaagggcagccucgugaccugcgccaaauuugccugcuccaagaaaaugacagggaagucuauccagccugaaaaccuggaguacagaauuaugcuuucugugcacggaucccaacacagcggcaugaucguuaaugacaccgggcaugaaacggaugagaaccgggcuaagguggagaucacacccaauucuccgagagcggaagccacccugggaggcuucggcagccucgggcuggacugugagccucgcaccggacuugauuuuuccgaccuguauuaccucacaaugaacaauaaacacuggcugguccauaaggaaugguuccacgauauuccccugccuuggcacgcuggcgccgacaccgggacaccccauuggaacaauaaagaggcccucguggaauuuaaggaugcucacgccaaacggcagacggucgugguucugggaucucaggagggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuucaccuuuacaaagaucccggcggagacccugcauggaacggugaccguugaagugcaguacgccggcacagacgggccuugcaaaguccccgcucaaauggccguggacaugcagacccucacaccugugggaagacugauuaccgcuaaccccguuaucacggaguccacagaaaacagcaagaugaugcuugagcuggaucccccuuucggcgacucuuacauugucaucggggugggcgagaaaaagaucacccaccacuggcaucgcuccggaagcacaauuggcaaggccuuugaagcgaccgugagaggggccaaacggauggcuguccucggagauaccgccugggacuucggcuccgucgggggagcucuuaauucucugggcaaggggauccaccagauuuucggcgccgccuuuaaaagccuguucggaggcauguccugguuuucucaaauccucauugggacacugcugauguggcucggacugaacacgaagaauggcagcaucucccuuaugugucuggcucucgggggaguucugaucuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4588 - RNA, 2284 nt, Artificial Sequence
  KY075932.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggauugaaaauuggaucuuucgcaacccuggcuucgcucuggccgcggccgcuaucgccuggcuccugggcuccagcacgucucagaaagugauuuaucuugucaugauccugcucauugcucccgccuacuccaucagaugcauuggggugagcaaucgggacuuuguugagggaaugucuggcgggacauggguggaugucgugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4589 - RNA, 2284 nt, Artificial Sequence
  KU870645.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauucugcgcaacccuggcuuugcucucgccgcggccgcuaucgccuggcugcuuggcuccagcacgucucagaaagucaucuaucuggugaugauucuccugaucgcucccgccuacuccauuagaugcaucgggguuagcaaucgggacuucguggagggaaugucuggcgggacaugggucgauguggugcuugaacauggaggcugugucaccguuauggcgcaggacaagccuacaguggauauugagcuggugaccaccacagucuccaacauggccgaggugcgcagcuacugcuaugaagcuagcaucuccgacauggccagcgauuccagaugucccacgcaaggggaggcuuaccucgacaagcagucugacacccaguauguuugcaaacggacacugguggaucgcggauggggcaauggcugugggcuguuuggaaagggcagccucgugaccugcgccaaauucgccugcuccaagaaaaugacagggaagucuauucagccugaaaaccuggaguacagaaucaugcuuucuguccacggaucccaacacagcggcaugaucguuaaugacaccgggcaugaaacggaugagaaccgggcuaagguggagauuacacccaauucuccgagagcggaagccacccugggaggcuuuggcagccucgggcuggacugugagccucgcaccggacuugauuucuccgaccuguauuaccucacaaugaacaauaaacacuggcugguccauaaggaaugguuucacgauaucccccugccuuggcacgcuggcgccgacaccgggacaccccauuggaacaauaaagaggcccucguggaguucaaggaugcucacgccaaacggcagacggucgugguucugggaucucaggaaggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuuuaccuucacaaagauuccggcggagacccugcauggaacggugaccguugaagugcaguacgccggcacagacgggccuugcaaaguccccgcucaaauggccguggacaugcagacccucacaccugugggaagacugaucaccgcuaaccccguuauuacggaguccacagaaaacagcaagaugaugcuugagcuggaucccccuuuuggcgacucuuacaucgucaucgggauuggcgagaaaaagaucacccaccacuggcaucgcuccggaagcacaauuggcaaggccuucgaagcgaccgugagaggggccaaacggauggcugugcucggagauaccgccugggacuuuggcuccgucgggggagcucuuaauucucugggcaaggggauccaccagauuuucggcgccgccuucaaaagccuguuuggaggcauguccugguucucucaaauccucaucgggacacugcugauguggcucggacugaacacgaagaauggcagcauuucccuuaugugucuggcucucgggggagugcugaucuuucugagcaccgcgguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4590 - RNA, 2284 nt, Artificial Sequence
  KU729217.2 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuuguguccaccaccgucagcaacauggccgaggugcgcucuuacugcuaugaagcuacaaucuccgacauugccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauuguuaaugacaccgggcaugaaacggaugagaaccgggcuaagguggagaucacaccgaauagccccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggcggucgugcucggaucucaggagggcgcuguucauaccgcccuggccggggcucuugaggccgaaauggacggcgcuaagggaagacugagcuccggccaccucaaaugccgccugaagauggauaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgacaugcagacccugacaccugugggaagacucauuaccgccaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggcguuugaagccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4591 - RNA, 2284 nt, Artificial Sequence
  KX087101.3 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaacugcaguacgccggcacagacgggccuugcaaagugcccgcucaaauggccgucgacaugcagacccucacaccugugggaagacugaucaccgcuaaccccgugauuacggaguccacagaaaacagcaagaugaugcuugagcuggaucccccuuucggcgacucuuacaucguuaucggggucggcgagaaaaagauuacccaccacuggcaucgcuccggaagcacaaucggcaaggccuuugaagcgaccgugagaggggccaaacggauggcugugcucggagauaccgccugggacuucggcuccgucgggggagcucuuaauucucugggcaaggggauucaccagaucuucggcgccgccuuuaaaagccuuuucggaggcauguccugguuuucucaaauucucaucgggacacugcugauguggcucggacugaacacgaagaauggcagcaucucccuuaugugucuggcucucgggggagugcugauuuuccugagcaccgcgguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4592 - RNA, 2284 nt, Artificial Sequence
  KY014317.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccaucgaaaacagcaagaugaugcuggagcuugaucccccuuucggcgacucuuacaucgucauuggggugggcgagaaaaagaucacacaccacuggcaucgcuccggaagcaccauuggcaaggccuuugaagcgacagugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuaucgggacccuccugauguggcugggacucaacacaaagaauggcagcauuucccugaugugucuugcucuugggggaguucucaucuuccugagcacggcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4593 - RNA, 2284 nt, Artificial Sequence
  KU758876.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgucaagggaagacugagcuccggccaccucaaaugccgccugaagauggauaaacuucggcugaagggggugagcuauucucucuguacagccgcuuucaccuuuacaaagauuccggccgagacccugcauggaacgguuaccguggaaguccaguacgcgggcacagacgggccuugcaaagugcccgcccaaauggcuguggacaugcagacccugacaccuguuggaagacucaucaccgccaaccccgucauuacggaguccacagaaaacagcaagaugaugcuggagcuugaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcugggagauaccgcuugggacuucggcuccguugggggagcccucaauucucugggcaaggggauucaccagaucuucggcgcugccuuuaaaagccuguucggaggcauguccugguuuucucaaauucuuaucgggacacuccugauguggcugggacucaacacgaagaauggcagcaucuccuucaugugucuggcccuugggggagugcugauuuuucucagcaccgcugucucugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4594 - RNA, 2284 nt, Artificial Sequence
  KU758874.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaaaacugagcuccggccaccucaagugcagacugaagauggauaaacuucgccugaagggggucagcuauucucucuguacagcugccuucaccuuuacaaaaauuccggcggagacccugcauggaacggugaccguugaagugcaguacgccggcacagacgggccuugcaagguccccgcucaaauggccguggacaugcagacccugacaccugugggacggcucaucaccgcuaaccccguuauuacggaguccacagaaaacagcaaaaugaugcuggagcuugaucccccuuucggcgacucuuacaucgucaucggggugggcgagaagaagauuacccaccacuggcauagauccggaagcacaaucggcaaagccuuugaagcgaccgugcgcggggccaagcggauggcuguccugggagauaccgccugggacuucggcuccgucgggggagcucucaauucucugggcaaagggauucaccagaucuucggcgccgccuuuaagagccuguucggaggcauguccugguuuucucaaauucuuaucgggacacuccugauguggcugggacucaacacgaaaaauggcagcaucucccugaugugucuugcucucgggggaguucugauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4595 - RNA, 2284 nt, Artificial Sequence
  KY317939.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaaggaugcuggcgaagccauuucuuuccccacaacccuggggaugaacaaaugcuauauccagauuauggaccucggacacaugugugaugccacaaugagcuacgagugcccuaugcuggacgaaggcguggagccggaugacguggauuguuggugcaauaccacauccaccugggucguguaugggacgugucaucacaagaaaggagaagcuagacggucucgcagagccguuacccuucccagccauuccacacggaagcugcaaacccgcucucagacauggcucgagagcagagaguacaccaaacaccugauccggguggaaaacuggauuuuucgcaauccuggcuucgcucuggccgcggccgcuaucgccuggcuccugggcuccagcacgucucagaaggucaucuaucuugugaugauucugcucaucgcucccgccuacuccauuagaugcaucgggguuagcaaccgggacuuuguggagggaaugucuggcgggacaugggucgauguggugcuggaacauggaggcugugucaccguuauggcgcaggacaagccuacaguggauauugagcuugugaccaccacagucuccaauauggccgaggugcgcagcuacugcuaugaagcuagcaucuccgacauggccagcgauuccagaugucccacgcaaggggaggcuuaccuggacaaacagucugacacccaguauguuugcaagcggacacucguggaucgcggauggggcaacggcugugggcuguucggaaaaggcagccuggugaccugcgccaaguuugccugcuccaaaaagaugacagggaagucuauucagccugaaaaucucgaguacagaaucaugcugucugugcacggaucccaacacagcggcaugaucguuaacgacaccgggcaugaaacggaugagaaucgggcuaaaguggagauuacaccgaacucucccagagcggaagccacccuuggaggcuucggcagccuggggcucgacugugagccucgcaccggacuggauuuuuccgaccuuuauuaccugacaaugaauaacaagcacuggcucguccauaaagaaugguuccacgauaucccccugccuuggcacgcuggcgccgacaccgggacaccccauuggaauaacaaggaggcccugguggaauuuaaagaugcucacgccaagcggcagacggucgugguucucggaucucaggagggcgcggugcauaccgcucuggccggggcccuugaggcugaaauggacggcgccaaaggaagacugagcuccggccaccucaagugccgccugaagauggauaaacuucggcugaagggggucagcuauucucucuguacagcugccuucaccuuuacaaaaauuccggcggagacccugcauggaacggugaccguugaagugcaguacgccggcacagacgggccuugcaagguccccgcucaaauggccguggacaugcagacccugacaccugugggaagacucaucaccgcuaaucccguuauuacggaguccacagaaaacagcaaaaugaugcuggagcuugaucccccuuucggcgacucuuacaucgucaucggggugggcgagaagaagauuacccaccacuggcaucgcuccggaagcacaaucggcaaagccuuugaagcgaccgugagaggggccaagcggauggcuguccugggagauaccgccugggacuucggcuccgucgggggagcucucaacucucugggcaaagggauucaccagaucuucggcgccgccuuuaagagccuguucggaggcauguccugguuuucucaaauucuuaucgggacacuccugauguggcugggacucaauacgaaaaacggcagcaucucccugaugugucuugcucucgggggaguucugauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4596 - RNA, 2284 nt, Artificial Sequence
  KY014314.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaggcucacgccaaacggcagacggucgugguucucggaucucaggagggcgcggugcauaccgcucuggccggggcccuugaagcugagauggauggcgccaagggaagacugagcuccggccaccucaaaugccgccugaagauggacaaacuucggcugaaaggggucagcuauucucucuguacagcugccuucaccuuuacaaagauuccggcggaaacccugcauggaacggugaccguugaggugcaguacgccggcacagaugggccuugcaaaguccccgcucaaauggccguggacaugcagacccugacaccugugggaagacucaucaccgcuaaccccguuauuacggaauccacagagaacagcaagaugaugcuggagcuugacccgccuuucggcgauucuuacaucgucaucggggugggcgaaaagaagauuacccaccacuggcaucgcuccggaagcacaaucggcaaggccuuugaggcgaccgugagaggggccaaacggauggcuguccugggagacaccgccugggauuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucucgggggaguucugauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4597 - RNA, 2284 nt, Artificial Sequence
  KX447517.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccgcucuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgccggcgccgacacagggaccccgcauuggaacaauaaagaggcucugguggaauuuaaggaugcccacgcgaaacggcagacagucgugguucucggaucucaggagggcgcugugcauacggcccuggccggggcucuugaggccgaaauggacggcgcuaagggaagacugagcuccggccaccucaaaugccgccugaagauggauaagcugcggcugaaaggggucagcuauucucucuguaccgccgcguucacauuuaccaagauuccggccgagacacugcauggaaccgugacgguugaagugcaguacgcuggcaccgacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccgucgggggagcccucaauucucugggcaaggggauucaccagaucuucggcgccgcuuuuaaaagccuguucggaggcauguccugguuuucucaaacccuuauugggacacuccugauguggcugggacucaacacgaagaauggcagcaucucccugaugugucuugcgcuugggggaguucucaucuuccugagcaccgccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4598 - RNA, 2284 nt, Artificial Sequence
  KU926310.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcgcugacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccgucgggggagcccucaauucucugggcaaggggauucaccagaucuucggcgccgcuuuuaaaagccuguucggaggcauguccugguuuucucaaauucuuaucgggacccuccugauguggcugggacucaacacaaagaauggcagcaucucccugaugugucuugcgcuugggggaguucucauuuuccugagcacggccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4599 - RNA, 2284 nt, Artificial Sequence
  KU922923.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugccccaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucuggccuacuccauuagaugcaucgggguuagcaaucgggacuuuguggagggaaugucuggcgggacaugggucgauguggugcuugaacauggaggcugugucaccguuauggcgcaggacaagcccacaguggauauugagcuggugaccaccacagucuccaacauggccgaggugcgcagcuacugcuaugaagcuagcaucuccgacauggccagcgauuccagauguccuacgcaaggggaggcuuaccucgacaagcagucugacacccaguauguuugcaaacggacacugguggaucgcggauggggcaauggcugugggcuguucggaaagggcagccucgugaccugcgccaaauuugccugcuccaagaaaaugacagggaagucuauucagcccgaaaaccuggaguacagaaucaugcuuucugugcacggaucccaacacagcggcaugaucguuaaugacaccgggcaugaaacggaugagaaccgggcuaagguggagauuacaccuaauucuccgagagcggaagccacccugggaggcuucggcagccucgggcuggacugugagccccgcaccggacuugauuuuuccgaccuguauuaccucacaaugaacaauaaacacuggcugguccauaaggaaugguuccacgauaucccucugcccuggcacgcuggcgccgacaccgggacaccucauuggaacaauaaagaggcccucguggaauuuaaggaugcucacgccaaacggcagacggucgugguucugggaucucaggagggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuucaccuuuacaaagauucccgcggagacccugcauggaacggugaccguugaagugcaguacgccggcacagacgggccgugcaaagucccugcucaaauggccguggacaugcagacccucacacccgugggaagacugaucaccgcuaacccuguuauuacggaguccacagaaaacagcaagaugaugcuugagcuggauccucccuucggcgacucuuacaucgucaucggggugggcgagaaaaagauuacccaccacuggcaucgcuccggaagcacaaucggcaaggccuuugaagcgaccgugagaggggccaaacggauggcuguccucggagauaccgccugggacuucggcuccgucgggggagcucuuaauucucugggcaaggggauucaccagaucuucggcgccgccuuuaaaagccuguucggaggcauguccugguuuucucaaauucucaucgggacacugcugauguggcucggacugaacacgaagaauggcagcaucucccuuaugugucuggcucucgggggaguucugauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4600 - RNA, 2284 nt, Artificial Sequence
  KY075937.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacaugguuagcgauuccagaugucccacgcaaggggaggccuaccuggacaagcagucugacacccaguaugugugcaaacggacacucgucgaucgcggauggggcaauggcugugggcuguucggaaagggcagccuggugaccugcgcuaaauuugccugcuccaagaaaaugacagggaagucuauucagccugaaaaccucgaguacagaaucaugcugucuguucacggaucccaacacagcggcaugaucgugaaugacaccgggcaugaaacggaugagaaccgggccaaggucgagauuacacccaauucuccgagagcugaagcgacccuuggaggcuucggcagccuggggcucgacugugagccucgcaccggacuggauuuuuccgaccuuuauuaccugacaaugaacaauaaacacuggcucgugcauaaggaaugguuccacgauaucccccugccuuggcacgccggcgcugacaccgggacaccccauuggaacaauaaagaggcccuggucgaauuuaaggaugcccacgcuaaacggcagacggugguugugcucggaucucaggagggcgccguccauaccgcgcuggcuggggcccuugaggccgaaauggacggcgcuaagggaagacugagcuccggccaccucaaaugccgccugaagauggauaagcugcggcugaaaggggugagcuauucucucuguacagccgcuuucaccuuuacaaagauuccggccgagacccugcauggaacgguuaccguggaaguccaguacgcgggcacagacgggccuugcaaagugcccgcccaaauggcuguggacaugcagacccugacaccuguuggaagacucaucaccgccaaccccgucauuacggaguccacagaaaacagcaagaugaugcuggagcuugaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcugggagauaccgcuugggacuucggcuccguugggggagcccucaauucucugggcaaggggauucaccagaucuucggcgcugccuuuaaaagccuguucggaggcauguccugguuuucucaaauucuuaucgggacacuccugauguggcugggacucaacacgaagaauggcagcaucucccugaugugucuugcccuugggggagugcucauuuuccugagcaccgcugucucugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4601 - RNA, 2284 nt, Artificial Sequence
  KY003156.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggauuagcaaucgggacuuuguugagggaaugucuggcgggacauggguggaugucgugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcauucuggggcucgacugugagccucgcaccggacuggauuuuagcgaccuuuauuaccugacaaugaacaauaaacacuggcucgugcauaaggaaugguuccacgauaucccccugccuuggcacgcuggcgccgacaccgggacaccccauuggaacaauaaagaggcccuggucgaauuuaaggaugcucacgccaaacggcagacgguggucgugcucggaucccaggagggcgcgguucauaccgcucuggccggggcccuugaggcugaaauggacggcgccaagggaagacugucuagcggccaccucaaaugccgccugaagauggauaagcugcggcugaaagggguguccuauagccucuguacagcugccuucaccuuuacaaagauuccggcggagacccugcauggaacggucaccguggaaguucaguacgccggcacagacgggccuugcaaagugcccgcucaaauggccgucgacaugcagacccugacaccugugggaagacucaucaccgcuaaccccgugaucacggagucuacagaaaacuccaagaugaugcuggagcuugaucccccuuucggcgacagcuacauuguuaucggggucggcgagaaaaagauuacccaccacuggcaucgcucuggauccacaaucggcaaggccuuugaagcgaccgugagaggggccaaacggauggcugugcugggagauaccgccugggacuucggcagcgucgggggagcucucaauucccugggcaaggggauucaccagaucuucggcgccgccuuuaaaucucuguucggaggcaugagcugguuuucccaaauccuuauugggacacuccugauguggcugggacucaacacgaagaauggcucuaucagccugaugugucuugcucuugggggagugcucauuuuccuguccaccgcgguuagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4602 - RNA, 2284 nt, Artificial Sequence
  KU312313.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccauccggaaacugcaaacccgcucucagacauggcucgagagcagagaguacaccaagcaccugauucggguggaaaauuggaucuuucgcaacccuggcuucgcucuggccgcggccgcuaucgccuggcuccugggcuccagcacgucucagaaagucauuuaucuugugaugauccugcucauugcucccgccuacuccaucagaugcauugggguuagcaaucgggacuuuguggagggaaugucuggcgggacaugggucgauguggugcuggaacauggaggcugugucaccguuauggcgcaggacaagccuacaguggauaucgagcuugugaccaccacagucuccaacauggccgaggugcgcagcuacugcuaugaagcuagcauuuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaaucaugcugucugugcacggaucccaacacagcggcaugauuguuaaugacaccgggcaugaaacggaugagaaccgggcuaagguggagaucacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagaucccggcggagacccugcauggaacggugaccguugaagugcaguacgccggcacagacgggccuugcaaaguccccgcucaaauggccguggacaugcagacccugacaccugugggaagacucauuaccgcuaaccccguuaucacggaguccacagaaaacagcaagaugaugcuggagcuugaucccccuuucggcgacucuuacaucgucauuggggugggcgagaaaaagaucacccaccacuggcaucgcuccggaagcacaauuggcaaggccuuugaagcgaccgugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacgcuaagaauggcagcauuucccugaugugucuugcgcuugggggaguucucaucuuccugagcacggccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4603 - RNA, 2284 nt, Artificial Sequence
  KY075935.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcucaaagaucucggcgcgccguuacccuucccagccauuccacaagaaaacugcagacccggucucagacauggcucgagagccgcgaguacaccaagcaccugaucagaguggaaaauuggauuuuucggaacccuggcuucgcucuggccgcggccgcuaucgccuggcuccugggcuccagcacgucucagaaagucaucuaucuugugaugauucugcucaucgcucccgccuacuccauucgcugcaucgggguuagcaauagagacuuuguggagggaaugucuggcgggacaugggucgauguggugcuggaacauggaggcugugucaccguuauggcgcaagacaagccuacaguggauauugagcuugugaccaccacagucuccaacauggccgaggugcggagcuacugcuaugaagcuagcaucuccgacauggccagcgauucccgcugucccacgcagggggaggcuuaccuggacaagcagucugacacccaguauguuugcaaaagaacacucguggaucggggauggggcaauggcugugggcuguucggaaagggcagccuggugaccugcgccaaauuugccugcuccaagaaaaugacagggaagucuauucaaccugaaaaccucgaguaccgcaucaugcugucugugcacggaucccagcacagcggcaugaucguuaaugacaccgggcaugaaacggaugagaacagagcuaagguggagauuacacccaauucuccgcgggcggaagccacccuuggaggcuucggcagccuggggcucgacugugagccuagaaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacgccagacggucgugguucucggaucucaggagggcgcggugcauaccgcucuggccggggcccuugaggcugaaauggacggcgccaagggacggcugagcuccggccaccucaaaugcagacugaagauggauaagcugcgccugaaaggggucagcuauucucucuguacagcugccuucaccuuuacaaagauuccggcggagacccugcauggaacggugaccguugaagugcaauacgccggcacagacgggccuugcaaaguccccgcucagauggccguggacaugcagacccugacaccugugggacggcucaucaccgcuaaccccguuauuacggaguccacagaaaacagcaagaugaugcuggagcuugaucccccuuucggcgacucuuacaucgucaucggggugggcgagaaaaagauuacccaccacuggcauagauccggaagcacaaucggcaaggccuuugaagcgaccgugcgcggggccaaacggauggcuguccugggagauaccgccugggacuucggcuccgucgggggagcucucaauucucugggcaaggggauucaccaaaucuucggcgccgccuuuaaaagccuguucggaggcauguccugguuuucucagauucuuaucgggacacuccugauguggcugggacucaacacgaagaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4604 - RNA, 2284 nt, Artificial Sequence
  KY014320.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaagcucgcucucagaccuggcucgagagcagagaguacacaaagcaccugauccggguggaaaauuggauuuuucgcaacccuggcuucgcccuggcggccgcugccaucgcuuggcuccugggcuccagcaccucucagaaagucaucuaucuugugaugauucugcucaucgcccccgcguacuccauuagaugcaucgggguuagcaaucgggacuuuguggagggaaugucuggcgggacgugggucgauguggugcuggaacauggaggcugugucacaguuauggcccaggacaagccuaccguggauauugagcuugugacaaccaccgucuccaacauggcugaggugcgcagcuacugcuaugaagccucuaucuccgacauggcuagcgauuccagaugucccacacaaggggaggccuaccuggacaagcagucugacacgcaguauguuugcaaacggacccucguggaucgcggauggggcaauggcugugggcuguucggaaagggcagccuggucacaugcgccaaauuugcuugcuccaagaaaaugaccggaaagagcauucagccugaaaaccucgaguacagaaucaugcugucugugcacgggucccaacacagcggcaugaucguuaaugacacagggcaugaaaccgaugagaaccgggcgaagguggagauuacgcccaauucucccagagccgaagcuacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgccggcgccgacacagggaccccgcauuggaacaauaaagaggcucugguggaauuuaaggaugcccacgcgaaacggcagacagucgugguucucggaucucaggagggcgcugugcauacggcccuggccggggcucuugaggccgaaauggacggcgcuaagggaagacugagcuccggccaccucaaaugccgccugaagauggauaagcugcggcugaaaggggucagcuauucucucuguaccgccgcguucacauuuaccaagauuccggccgagacacugcauggaaccgugacgguugaagugcaguacgcuggcaccgacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccguugggggagcccucaauucucugggcaaggggauucaccagaucuucggcgccgcuuuuaaaagccuguucggaggcauguccugguuuucucaaauucuuaucgggacccuccugauguggcugggacucaacacaaagaauggcagcaucucccugaugugucuugcgcuugggggagugcucauuuuccugagcacggccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4605 - RNA, 2284 nt, Artificial Sequence
  KY328290.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccguccacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaaacuucggcugaaaggggucucuuauucccucuguacagcugccuucaccuuuagcaagauuccggcggagacacugcauggaaccgugacggaagagguucaguacgccggcaccgacgggccuugcaaagugcccgcucaaauggccgucgacaugcagacacugaccccugugggaagacucaucacagcuaaucccgugauuaccgaaucuacggagaacuccaagaugaugcuggagcuugaucccccuuucggcgacagcuacaucguuaucggggucggcgaaaagaagauuacacaccacuggcaucgcuccggaucuaccaucggcaaggccuuugaggcgacagugagaggggccaaacggauggcugugcugggagauaccgccugggacuucggcagcgucgggggagcucucaacucccugggcaaggggauucaccagaucuucggcgccgccuuuaaaucucuguucggaggcaugagcugguuuucccaaauucuuaucgggacccuccugauguggcugggacucaauacaaagaacggcagcaucucucugaugugucuugcucucgggggagugcugauuuuccuguccacggcgguuagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4606 - RNA, 2284 nt, Artificial Sequence
  KU681081.3 prME-short mRNA Design 1 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccguccacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacaccggcgcugacacagggacgccccauuggaauaacaaagaggcccugguggaauuuaaggaugcccacgcuaaacggcagaccgucgugguucucggaagccaggagggcgccgugcauacagcgcuggcuggggcccuugaggccgaaauggacggcgcuaagggaagacuguccagcggccaccucaaaugccgccugaagauggauaaacuucggcugaagggggucucuuauucccucuguaccgccgcuuucacauuuaccaagauuccggccgagacgcugcauggaaccgugacaguugaagugcaguacgcgggcaccgacgggccuugcaaaguccccgcccaaauggcuguggacaugcagacacugaccccugugggaagacucaucacggccaaucccguuauuacagagggcaccgaaaacagcaagaugaugcuggagcuugaucccccuuucggggacucuuacaucgucaucggcgugggagagaaaaagauuacacaccacuggcaucgcuccggcagcaccaucgggaaggcuuuugaagccaccgugcggggagcgaaaagaauggccguccugggcgauacagcuugggacuucggguccgugggaggcguucucaacucucuggggaagggcauucaccagaucuucggagccgcuuuuaaaagccuguucggcgggauguccugguuuucucaaauucuuaucggaacgcuccugauguggcugggccucaauaccaagaacgggagcaucucccugaugugucuugcccugggaggcgugcucauuuuccugagcacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4607 - RNA, 2284 nt, Artificial Sequence
  KX827309.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccgugcacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaucccguuauuacggagagcacagaaaacucuaagaugaugcuggagcuugaucccccuuucggcgacuccuacaucgucaucggggugggcgagaaaaagauuacccaccacuggcaucgcagcggauccacaaucggcaaggccuuugaagcgaccgugagaggggccaaacggauggcuguccugggagauaccgccugggacuucggcucugucgggggagcucucaacagccugggcaaggggauucaccagaucuucggcgccgccuuuaaaucccuguucggaggcaugucuugguuuagccaaauucuuaucgggacacuccugauguggcugggacucaauacgaagaacggcuccaucagccugaugugucuugcucuugggggaguucucauuuuccugucuaccgcgguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4608 - RNA, 2284 nt, Artificial Sequence
  KU955593.1 prME-short mRNA Design 1 opt
gggagaaagcuuaccaugaccagcgugggcaucgucgggcugcuccugacaacggccauggcuguugaggugaccagacggggaaacgccuacuauauguaccuugaccgcuccgaugcgggcgaagcuauuucuuuccccacaaccauggggaugaauaagugcuauauccagauuauggaccugggacacaugugugaugccacaaugagcuacgagugcccuaugcucgacgaaggcguggagccggaugacgucgauuguuggugcaacaccacauccaccugggugguuuaugggacgugucaucacaaaaagggagaagccagacggucucgcagagcugugacccugcccagccauuccacacggaaacuucaaacccgcucucagacauggcuggagagcagagaguacaccaagcaccucauccgggucgaaaauuggauuuuucgcaacccuggcuucgcccuggcugccgcggccaucgcuuggcugcucggcuccagcacgucucagaaagugaucuaucugguuaugauucuucugaucgcccccgcuuacuccauuagaugcaucggggugagcaaucgggacuuugucgagggaaugucuggcgggacauggguggaugugguccucgaacauggaggcuguguuaccgugauggcccaggacaagccuacaguggauauugagcuggucaccaccacaguguccaacauggcggagguucgcagcuacugcuaugaagccucuaucuccgacauggcuagcgauuccagaugucccacgcaaggggaggccuaccuugacaagcagucugacacccaguaugugugcaaacggacacuggucgaucgcggauggggcaauggcugugggcuguucggaaagggcagccuggugaccugcgcuaaauuugccugcuccaagaaaaugacagggaagucuauucagccugaaaaccuggaguacagaaucaugcucucuguucacggaucccaacacagcggcaugaucgugaaugacaccgggcaugaaacggaugagaaccgggccaaggucgagauuacaccgaauagccccagagcugaagcgacccugggaggcuucggcagccuugggcuggacugugagccucgcaccggacucgauuuuuccgaccuguauuaccuuacaaugaacaauaaacacuggcuggugcauaaggaaugguuccacgauaucccccucccuuggcacgccggcgcugacaccgggacaccccauuggaacaauaaagaggcccuggucgaauuuaaggaugcccacgcuaaacggcagacggugguugugcugggaucucaggagggcgccguccauaccgcgcucgcuggggcccuggaggccgaaauggacggcgcuaagggaagacuuagcuccggccaccugaaaugccgccucaagauggauaagcugcggcuuaaaggggugagcuauucucuguguacagccgcuuucaccuuuacaaagauuccggccgagacccuccauggaacgguuaccguggaaguccaguacgcgggcacagacgggccuugcaaagugcccgcccaaauggcuguggacaugcagacccugacaccuguuggaagacugaucaccgccaaccccgucauuacggaguccacagaaaacagcaagaugaugcucgagcuggaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcuuggagauaccgcuugggacuucggcuccguugggggagcccucaauucucucggcaaggggauucaccagaucuucggcgcugccuuuaaaagccuguucggaggcauguccugguuuucucaaauucugaucgggacacuucucguguggcugggacugaacacgaagaauggcagcaucucccucaugugucuggcccuugggggaguccugauuuuccucagcaccgcugugucugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4609 - RNA, 2284 nt, Artificial Sequence
  KY272987.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccgugcacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaucccguuauuacggagagcacagaaaacucuaagaugaugcuggagcuugaucccccuuucggcgacuccuacaucgucaucggggugggcgagaaaaagauuacccaccacuggcaucgcagcggauccacaaucggcaaggccuuugaagcgaccgugagaggggccaaacggauggcuguccugggagauaccgccugggacuucggcucugucgggggagcucucaacagccugggcaaggggauucaccagaucuucggcgccgccuuuaaaucccuguucggaggcaugucuugguuuagccaaauucuuaucgggacacuccugauguggcugggacucaauacgaagaacggcuccaucagccugguuugucuugcucuugggggagugcucauuuuccugucuaccgcggucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4610 - RNA, 2284 nt, Artificial Sequence
  KY007221.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuaacaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugguuugucuugcucuugggggagugcucauuuuccugagcaccgcggucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4611 - RNA, 2284 nt, Artificial Sequence
  EU545988.1 prME-short mRNA Design 1 opt
gggagaaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccuggggaugaacaagugcuauauccagauuauggaccucggacacaugugugaugccacaauguccuacgagugcccuaugcuggacgaaggcguggagccggaugacgucgauuguuggugcaauaccacaucuaccugggugguuuaugggacgugucaucacaaaaagggagaagccagacggagccgcagagcugugacccuucccucccauucuacacggaaacugcaaacccgcagccagacauggcucgaguccagagaguacaccaagcaccugauccgggucgaaaacuggauuuuucgcaauccuggcuucgcccuggcugccgcggccaucgcuuggcuccugggcagcucuacgucccagaaagugaucuaucuuguuaugauucugcucaucgcccccgcuuacagcauuagaugcaucggggugucuaaccgggacuuugucgagggaauguccggcgggacauggguggaugugguccuggaacauggaggcuguguuaccgugauggcccaggacaagccugcgguggauauugagcuugucacaaccaccgugagcaauauggccgagguucgcucuuacugcuaugaagccuccaucagcgacauggcuuccgauucuagaugucccacacaaggggaggcuuaccuggacaagcagagcgacacgcaguaugugugcaaacggacccucgucgaucgcggauggggcaacggcugugggcuguucggaaagggcucccuggugacaugcgccaaauuugccugcagcaagaaaaugaccgggaagucuauucagccugaaaaucucgaguacagaaucaugcuguccguucacggaagccaacacucuggcaugaucgugaacgacacagggcaugaaaccgaugagaaucgggcuaaggucgagauuacgccgaacagccccagagcggaagccacacuuggaggcuucggcucccuggggcucgacugugagccucgcaccggacuggauuuuucugaccuuuauuaccugaccaugaauaacaaacacuggcucgugcauaaggaaugguuccacgauaucccccugccuuggcacgcuggcgccgacacagggacaccccauuggaauaacaaagaggcccuggucgaauuuaaggaugcucacgccaaacggcagaccgugguugugcucggaagccaggagggcgcgguccauacggcucuggccggggcccuugaggcugaaauggacggcgccaagggaagacuguccagcggccaccucaaaugccgccugaagauggauaagcugcggcugaaaggggugucuuauucccucuguaccgcugccuucacauuuaccaagauuccggcggagacacugcauggaaccguuacgguggaaguccaguacgccggcaccgacgggccuugcaaagugcccgcucaaauggccguggacaugcagacacugaccccuguuggaagacucaucacagcuaaucccgucauuaccgagagcacggaaaacucuaagaugaugcuggagcuugaucccccuuucggcgacuccuacaucgugaucggggugggcgagaaaaagauuacacaccacuggcaucgcagcggauccaccaucggcaaggccuuugaagcgacagucagaggggccaaacggauggcugugcugggagauaccgccugggacuucggcucuguugggggagcucucaacagccugggcaaggggauucaccagaucuucggcgccgccuuuaaaucccuguucggaggcaugucuugguuuagccaaauucuuaucgggacccuccugguguggcugggacucaauacaaagaacggcuccaucagccugacgugucuugcucuugggggaguccucauuuuccugucuaccgcgguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4612 - RNA, 2284 nt, Artificial Sequence
  KU681082.3 prME-short mRNA Design 1 opt
gggagaaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccuggggaugaacaagugcuauauccagauuauggaccucggacacaugugugaugccacaauguccuacgagugcccuaugcuggacgaaggcguggagccggaugacgucgauuguuggugcaauaccacaucuaccugggugguuuaugggacgugucaucacaaaaagggagaagccagacggagccgcagagcugugacccuucccucccauucuacacggaaacugcaaacccgcagccagacauggcucgaguccagagaguacaccaagcaccugauccgggucgaaaacuggauuuuucgcaauccuggcuucgcccuggcugccgcggugaucgccuggcuccugggcagcucuacgucccagaaaguuaucuaucuugugaugauucugcucaucgcucccgccuacagcauuagaugcaucggggucucuaaccgggacuuuguggagggaauguccggcgggacauggguggaugucguucuggaacauggaggcugugugaccgugauggcucaggacaagccuacagucgauauugagcuugugaccaccacaguuagcaauauggccgaggugcgcucuuacugcuaugaagcguccaucagcgacauggccuccgauucuagaugucccacgcaaggggaggcuuaccuggacaagcagagcgacacccaguaugucugcaaacggacacucguggaucgcggauggggcaacggcugugggcuguucggaaagggcucccugguuaccugcgccaaauuugcuugcagcaagaaaaugacagggaagucuauucagccugaaaaucucgaguacagaaucaugcuguccgugcacggaagccaacacucuggcaugaucgucaacgacaccgggcaugaaacggaugagaaucgggccaagguggagauuacaccgaacagccccagagccgaagcuacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcgggcgccgacaccgggacaccccauuggaauaacaaagaggcucugguggaauuuaaggaugcccacgccaaacggcagacgguugugguccucggaagccaggagggcgcugugcauaccgcccuggcgggggcucuugaggccgaaauggacggcgccaagggaagacuguccagcggccaccucaaaugccgccugaagauggauaagcugcggcugaaagggguuucuuauucccucuguacagcugccuucaccuuuacaaagauuccggcugagacccugcauggaacggugaccgucgaagugcaguacgccggcacagacgggccuugcaaagugcccgcgcaaauggccguugacaugcagacccugacaccugucggaagacucaucaccgcuaaucccgugauuacggagagcacagaaaacucuaagaugaugcuggagcuugaucccccuuucggcgacuccuacaucgugaucggggucggcgagaaaaagauuacccaccacuggcaucgcagcggauccacaaucggcaaggccuuugaagcuaccgugagaggggccaaacggauggcgguucugggagauaccgccugggacuucggcucugucgggggagcucucaacagccugggcaaggggauucaccagaucuucggcgccgcuuuuaaaucccuguucggaggcaugucuugguuuagccaaauucuuaucgggacacuccugguguggcugggacucaauacgaagaacggcuccaucagccugaccugucuugcccuugggggagugcucauuuuccugucuacagccguuuccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4613 - RNA, 2284 nt, Artificial Sequence
  KX601167.1 prME-short mRNA Design 1 opt
gggagaaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccugggggugaacaagugcuauauccagauuauggaccucggacacaugugugaugccacaauguccuacgagugcccuaugcuggacgaaggcgucgagccggaugacguggauuguuggugcaauaccacaucuaccuggguuguguaugggacgugucaucacaaaaagggagaagccagacggagccgcagagcugucacccuucccucccauucuacacggaaacugcaaacccgcagccagacauggcucgaguccagagaguacaccaagcaccugauccggguggaaaacuggauuuuucgcaauccuggcuucgcccuggcugccgcggccaucgcuuggcuccugggcagcucuacgucccagaaaguuaucuaucuugugaugauucugcucaucgcccccgcuuacagcauuagaugcaucggggucucuaaccgggacuuuguggagggaauguccggcgggacauggguggaugucguucuggaacauggaggcugugugaccgugauggcccaggacaagccuacagucgauauugagcuugugaccaccacaguuagcaauauggcggaggugcgcucuuacugcuaugaagccuccaucagcgacauggcuuccgauucuagaugucccacgcaaggggaggccuaccuggacaagcagagcgacacccaguaugucugcaaacggacacucguggaucgcggauggggcaacggcugugggcuguucggaaagggcucccugguuaccugcgcuaaauuugccugcagcaagaaaaugacagggaagucuauucagccugaaaaucucgaguacagaaucaugcuguccgugcacggaagccaacacucuggcaugaucgucaacgacaccgggcaugaaacggaugagaaucgggccaagguggagauuacaccgaacagccccagagcugaagcgacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgccggcgcugacaccgggacaccccauuggaauaacaaagaggcccugguggaauuuaaggaugcccacgcuaaacggcagacgguugugguccucggaagccaggagggcgccgugcauaccgcgcuggcuggggcccuugaggccgaaauggacggcgcuaagggaagacuguccagcggccaccucaaaugccgccugaagauggauaagcugcggcugaaagggguuucuuauucccucuguacagccgcuuucaccuuuacaaagauuccggccgagacccugcauggaacggugaccgucgaagugcaguacgcgggcacagacgggccuugcaaagugcccgcccaaauggcuguugacaugcagacccugacaccugucggaagacucaucaccgccaaucccgugauuacggagagcacagaaaacucuaagaugaugcuggagcuugaucccccuuucggcgacuccuacaucgugaucggggucggcgauaaaaagauuacccaccacugguaucgcagcggauccacaaucggcaaggcuuuugaggccaccgugagaggggcgaaacggauggccguucugggagacaccgcuugggauuucggcucugucgggggagcccucaacagccugggcaaggggauucaucagaucuucggcgcugccuuuaaaucccuguucggaggcaugucuugguuuagccaaauucuuaucgggacacuccugguguggcugggacucaauacgaagaacggcuccaucagccugaccugucuugcccuugggggagugcucauuuuccugucuacagcuguuuccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4614 - RNA, 2284 nt, Artificial Sequence
  KX694533.2 prME-short mRNA Design 1 opt
gggagaaagcuuaccaugaccagcgugggcaucgucgggcugcuccugacaacggccauggcuguugaggugaccagacggggauccgccuacuauauguaccuugaccgcucugaugcgggcaaggcuauuagcuuccccacaacccugggggugaacaaaugcuauauccagauuauggaccucggacacaugugugaugccacaauguccuacgaaugcccuaugcuggacgagggcgucgaaccggaugacguggauuguuggugcaauaccacaucuaccuggguuguguaugggacgugucaucacaagaaaggagaggccagacggagccgcagagcugucacccuucccucccauucuacacggaagcugcaaacccgcagccagacauggcucgaauccagagaguacaccaaacaccugauccggguggagaacuggauuuuucgcaauccuggcuucgcccuggcugccgcggccaucgcuuggcuccugggcagcucuacgucccagaagguuaucuaucuugugaugauucugcucaucgcccccgcuuacagcauuagaugcaucggggucucuaaccgggacuuuguggaaggaauguccggcgggacauggguggaugucguucuggagcauggaggcugugugaccgugauggcccaggacaagccuacagucgauauugaacuugugaccaccacaguuagcaauauggcggaggugcgcucuuacugcuaugaggccuccaucagcgacauggcuuccgauucuagaugucccacgcaaggggaagccuaccuggacaaacagagcgacacccaguaugucugcaagcggacacucguggaucgcggauggggcaacggcugugggcuguucggaaaaggcucccugguuaccugcgcuaaguuugccugcagcaaaaagaugacagggaagucuauucagccugagaaucucgaauacagaaucaugcuguccgugcacggaagccaacacucuggcaugaucgucaacgacauugggcaugagaccgaugaaaaucgggccaaaguggagaucacgccgaacagccccagagcugaggcgacacuuggaggcuucggcucccuggggcucgacugugaaccucgcaccggacuggauuuuucugaccuuuauuaccugaccaugaauaacaagcacuggcucguccauaaagagugguuccacgauauuccccugccuuggcacgccggcgcugacacagggacaccccauuggaauaacaaggaagcccugguggaguuuaaagaugcccacgcuaagcggcagacaguugugguccucggaagccaggaaggcgccgugcauacggcgcuggcuggggcccuugaggccgagauggacggcgcuaaaggaagacuguccagcggccaccucaagugccgccugaagauggauaaacuucggcugaaggggguuucuuauucccucuguaccgccgcuuucacauuuaccaaaaucccggccgaaacacugcauggaaccgugacggucgaggugcaguacgcgggcaccgacgggccuugcaaggugcccgcccaaauggcuguugacaugcagacacugaccccugucggaagacucauuacagccaaucccgugaucaccgaaagcacggagaacucuaaaaugaugcuggaacuugaucccccuuucggcgacuccuacaucgugauuggggucggcgauaagaagaucacacaccacuggcaucgcagcggauccaccauuggcaaggcuuuugaggccacagugagaggggcgaaacggauggccguucugggagacaccgcuugggauuucggcucugucgggggagcccucaacagccugggcaaagggauccaccagauuuucggcgcugccuuuaagucccuguucggaggcaugucuugguuuagccaaauccuuaucgggacccuccugguguggcugggacucaauaccaaaaacggcuccauuagccugacgugucuugcccucgggggagugcugaucuuccugucuaccgcuguuuccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4615 - RNA, 2284 nt, Artificial Sequence
  KY288905.1 prME-short mRNA Design 1 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucacgcuggucgccguggcgaucgccuggcuccugggcagcucuacaucccagaagguuauuuaccuugugaugauccugcucauugcuccugccuauagcauccgcugcauuggggucucuaacagagacuuuguggaaggaauguccggcgggaccuggguggaugucguucuggagcacggaggcugugugacagugauggcucaggacaaacccaccgucgauaucgaacuugugaccacaacgguuagcaauauggccgaggugcggucuuacugcuacgaggcguccauuagcgacauggccuccgauucucgcuguccuacccaaggggaggcuuaucuggacaagcagagcgacacacaguacgucugcaaaagaacccucguggaucggggauggggcaacggcugugggcuguucggaaagggcucccugguuacaugcgccaaauuuaccugcagcaagaagaugacggggaaaucuauccagcccgaaaaucucgaauaucgcaucaugcuguccgugcacggaagccaacauucuggcaugauugucaacgacacagggcacgagaccgaugaaaauagagcuaagguggaggucaccccuaacagcccgcgggccgaggccacacuuggaggcuucggcucccuggggcucgacugugaacccagaaccggacuggauuuuucugaccuuuacuaucugacaaugaauaacaaacauuggcucgugcacaaggagugguuccacgauaucccucugcccuggcaugcuggcgcggacacggggaccccucacuggaauaacaaagaagcccugguugaguuuaaggaugcucaugccaaacgccagacaguggucgugcucggaagccaggaaggcgccguucacaccgcucuggccggggcgcuugaggcugagauggacggcgccaagggacggcuguucuccggccaucucaagugcagacugaaaauggauaaacuucgccugaagggggugagcuacucucucuguacagccgcuuuuaccuucacgaagguccccgccgaaacccugcacggaacagugaccguggagguucaguaugcuggcacagacgggccgugcaaagucccugcccaaauggcgguggacaugcagacccugacgcccgugggacggcucauuacagccaauccugucaucaccgaauccacagagaacagcaagaugaugcuggaacuugauccucccuuuggcgacucuuacauugugaucgggguuggcgauaagaaaaucacccaccauuggcacagauccggaagcaccauuggcaaggcuuucgaggccacagugcgcggggcuaaacggauggccguccugggagacacggcgugggauuucggcuccguugggggaguguuuaacucucucggcaaggggauccaucagauuuucggcgccgcuuuuaaaagccuguucggaggcauguccugguuuucucaaauccugauugggacccuucucguguggcugggacugaauacaaagaacggcagcaucucccucaccugucuggcccuugggggagucaugaucuuccugagcacagcugugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4616 - RNA, 2284 nt, Artificial Sequence
  KF268950.1 prME-short mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaaaccugggggugaauaaaugccacguccagauuauggaccucggacauaugugugaugcuaccauguccuaugaaugccccaugcuggacgagggcguugaacccgaugacguggauuguuggugcaacacaaccucuacauggguggucuacgggaccugucaccauaagaaaggagaggccagacggagccgcagagcugugacgcuuccgucccacucuacccggaagcugcaaacacgcagccagaccuggcucgaauccagagaguauacaaaacaucugaucaagguugagaauuggaucuuucggaaccccggcuucgcccuggcggccguggcuauugccuggcuccugggcagcucuaccucccagaaggucaucuaccuugugaugauucugcucaucgcuccugccuauagcauucgcugcaucgggguuucuaauagagacuuuguggaaggaauguccggcgggacgugggucgauguggugcuggagcacggaggcugugucacaguuauggcgcaggacaaacccaccguggauauugaacuugugacaaccaccgucagcaacauggccgaggugcggucuuacugcuacgaggcuuccaucagcgacauggccuccgauucucgcuguccuacacaaggggaggcuuaucuggacaagcagagcgacacgcaguacguuugcaaaagaacccucguggaucggggauggggcaauggcugugggcuguucggaaagggcucccuggucacaugcgccaaauuuaccugcagcaagaagaugacagggaaaucuauccagcccgaaaaccucgaauaucgcauuaugcuguccgugcacggaagccaacauucuggcaugaucguuaaugacauugggcacgagaccgaugaaaacagagccaagguggaggucacgccuaauagcccgcgggcugaggcgacacuuggaggcuucggcucccuggggcucgacugugaacccagaaccggacuggauuuuucugaccuuuacuaucugaccaugaacaauaaacauuggcucgugcacaaggagugguuccacgauaucccucugcccuggcaugccggcgcugacacagggaccccucacuggaacaauaaagaagcccuggucgaguuuaaggaugcccaugcuaaacgccagacagugguugugcucggaagccaggaaggcgccguccacacggcgcuggcuggggcccuugaggccgagauggacggcgcuaagggacggcuguucuccggccaucucaagugcagacugaaaauggauaaacuucgccugaagggggugagcuacucucucuguaccgccgcuuuuacauucaccaagguucccgccgaaacacugcacggaaccgugacggucgaggugcaguaugcgggcaccgacgggccgugcaaagugccugcccaaauggcuguugacaugcagacacugacccccgucggacggcucauuacagccaacccugugaucaccgaauccacggagaacagcaagaugaugcuggaacuugauccucccuuuggcgacucuuacaucgugauuggggucggcgauaagaaaaucacacaccauuggcacagauccggaagcaccauuggcaaggcuuucgaggccacagugcgcggggcgaaacggauggccguucugggagacaccgcuugggauuucggcuccgucgggggaguguuuaauucucucggcaagggggugcaucagaucuucggcgccgcuuuuaaaagccuguucggaggcauguccugguuuucucaaauucugaucgggacccuucucguuuggcugggacugaacacaaagaauggcagcaucucccucacgugucuggcccuugggggagugaugauuuuccugagcaccgccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4617 - RNA, 2284 nt, Artificial Sequence
  KF383121.1 prME-short mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucgugaacgacauugggcacgagacggaugaaaauagagccaaggucgaggugacaccuaacagcccgcgggccgaggcuacccuuggaggcuucggcucccuggggcucgacugugaacccagaaccggacuggauuuuucugaccuuuacuaucugacaaugaauaacaaacauuggcucguccacaaggagugguuccacgauaucccucugcccuggcaugcgggcgccgacaccgggacaccucacuggaauaacaaagaagcucugguggaguuuaaggaugcccaugccaaacgccagacgguugugguccucggaagccaggaaggcgcugugcacaccgcccuggcgggggcucuugaggccgagauggacggcgccaagggacggcuguucuccggccaucucaagugcagacugaaaauggauaaacuucgccugaaggggguuagcuacucucucuguacagcugccuuuaccuucacaaaggugcccgcugaaacccugcacggaacggucaccguggaggugcaguaugccggcacagacgggccgugcaaaguuccugcgcaaauggccgucgacaugcagacccugacacccgugggacggcucauuaccgcuaauccugugaucacggaauccacagagaacagcaagaugaugcuggaacuugauccucccuuuggcgacucuuacaucgucauuggggugggcgauaagaaaaucacccaccauuggcacagauccggaagcacaauuggcaaggccuucgaggcuaccguucgcggggccaaacggauggcggugcugggagacaccgccugggauuucggcuccgucgggggaguguuuaacucucucggcaaggggauccaucagauuuucggcgcugccuuuaaaagccuguucggaggcauguccugguuuucucaaauccugaucgggacacuucucguuuggcugggacugaauacgaagaacggcagcauuucccucaccugucuggcucuugggggagugaugaucuuccugagcacagccgucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4618 - RNA, 2266 nt, Artificial Sequence
  KF268949.1 prME-short mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaaaccugggggugaauaaaugccacguccagauuauggaccucggacauaugugugaugcuaccauguccuaugaaugccccaugcuggacgagggcguugaacccgaugacguggauuguuggugcaacacaaccucuacauggguggucuacgggaccugucaccauaagaaaggagaggccagacggagccgcagagcugugacgcuuccgucccacucuacccggaagcugcaaacacgcagccagaccuggcucgaauccagagaguauacaaaacaucugaucaagguugagaauuggaucuuucggaaccccggcuucgcccuggcggccguggcuauugccuggcuccugggcagcucuaccucccagaaggucaucuaccuugugaugauucugcucaucgcuccugccuauagcauucgcugcaucgggguuucuaauagagacuuuguggaaggaauguccggcgggacgugggucgauguggugcuggagcacggaggcugugucacaguuauggcgcaggacaaacccaccguggauauugaacuugugacaaccaccgucagcaacauggccgaggugcggucuuacugcuacgaggcuuccaucagcgacauggccuccgauucucgcuguccuacacaaggggaggcuuaucuggacaagcagagcgacacgcaguacguuugcaaaagaacccucguggaucggggauggggcaauggcugugggcuguucggaaagggcucccuggucacaugcgccaaauuuaccugcagcaagaagaugacagggaaaucuauccagcccgaaaaccucgaauaucgcauuaugcuguccgugcacggaagccaacauucuggcaugaucguuaaugacgagaacagagccaagguggaagucaccccuaauagcccgcgggcugaggcgacgcuugggggauucggcucccugggccucgauugugagcccagaacagggcuggacuuuucugaucuuuacuaucugaccaugaacaauaaacacuggcucgugcauaaggaaugguuccacgacauuccucugcccuggcacgccggagcugauaccggcacaccucauuggaacaauaaagaggcccuggucgaauuuaaggacgcccacgcuaaacgccagaccgugguugugcucgggagccaggagggagccguccauacagcgcuggcuggcgcccuugaagccgagauggauggggcuaagggccggcuguucuccggacaccucaagugcagacugaaaauggacaaacuucgccugaagggcgugagcuacucucucuguacggccgcuuuuaccuucacaaagguucccgccgagacccugcaugggacagugaccgucgaagugcaguaugcgggaacggauggcccgugcaaagugccugcccaaauggcuguugacaugcagacccugacacccgucgggcggcucaucaccgccaacccugugauuacagaguccaccgaaaacagcaagaugaugcuggagcuugacccucccuuuggagauucuuacaucgugaucggcgucggggacaagaaaauuacgcaccacuggcauagauccggcagcacaaucggaaaggcuuucgaagccaccgugcgcggcgcgaaacggauggccguucugggggauacagcuugggacuucggauccgugggcggggucuuuaauucucucggaaagggcauucaccagaucuucggggccgcuuuuaaaagccuguucggcggaauguccugguuuucucaaauucugaucggcacccuucucguguggcuggggcugaacaccaagaauggaagcaucucccucacaugucuggcccuuggcgggguuaugauuuuccugagcacggccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4619 - RNA, 2284 nt, Artificial Sequence
  KU955595.1 prME-short mRNA Design 1 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcacggaggcugugugaccgugauggcccaggacaaacccacagucgauaucgaacuugugaccaccacaguuagcaauauggcggaggugcggucuuacugcuacgaggccuccauuagcgacauggcuuccgauucucgcuguccuacgcaaggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccagcccgagaaucucgaauaucgcaucaugcuguccgugcacggaagccaacauucuggcaugauugucaacgacacggggcacgagacagaugaaaauagagccaagguggaggucaccccuaacagcccgcgggccgaggcuacccuuggaggcuucggcucccuggggcucgacugugaacccagaacaggacuggauuuuucugaccuuuacuaucugaccaugaauaacaaacauuggcucgugcacaaggagugguuccacgauaucccucugcccuggcaugcgggcgccgacacagggacgccucacuggaauaacaaagaagcucugguugaguuuaaggaugcccaugccaaacgccagaccguggucgugcucggaagccaggaaggcgcuguucacacagcccuggcgggggcucuugaggccgagauggacggcgccaagggacggcuguucuccggccaucucaagugcagacugaaaauggauaaacuucgccugaagggggugagcuacucucucuguaccgcugccuuuacauucaccaagguccccgcugaaacgcugcacggaaccgugacaguggagguucaguaugccggcaccgacgggccgugcaaagucccugcgcaaauggccguggacaugcagacacugacccccgugggacggcucauuacggcuaauccugucaucacagaauccaccgagaacagcaagaugaugcuggaacuugauccucccuuuggcgacucuuacauugugaucgggguuggcgauaagaaaaucacacaccauuggcacagauccggaagcaccauuggcaaggccuucgaggcuaccgugcgcggggccaaacggauggcgguccugggagacacagccugggauuucggcuccguugggggaguguuuaacucucucggcaaggggauccaucagauuuucggcgcugccuuuaaaagccuguucggaggcauguccugguuuucucaaauccugauugggacgcuucucguguggcugggacugaauaccaagaacggcagcaucucccucacaugucuggcucuugggggagucaugaucuuccugagcaccgccgugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4620 - RNA, 2284 nt, Artificial Sequence
  KF383116.1 prME-short mRNA Design 1 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaacacaagaaaggagaggccagacggagccgcagagcuguuacccuuccgucccauucuacacggaagcugcagacccgcagccagacauggcucgaauccagagaguauaccaaacaccugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcauggaggcugugugaccgugauggcccaagacaaacccacagucgauaucgaacuugugaccaccacaguuagcaauauggcggaggugcggucuuacugcuacgaggccuccauuagcgacauggcuuccgauucucgcuguccuacgcagggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccaacccgagaaucucgaauaucgcaucaugcuguccgugcacggaagccagcacucuggcaugauugucaacgacaucgggcaugagacggaugaaaauagagccaagguggaggucacaccuaacagcccgcgggccgaggcuacccuuggaggcuucggcucccuggggcucgacugugaacccagaaccggacuggauuuuucugaccuuuacuaucugacaaugaauaacaaacacuggcucgugcauaaggagugguuccacgauauuccucugcccuggcacgcgggcgccgacaccgggacaccucauuggaauaacaaagaagcucugguugaguuuaaggaugcccacgccaaacgccagacgguggucgugcucggaagccaggaaggcgcuguucauaccgcccuggcgggggcucuugaggccgagauggacggcgccaagggacggcuguucuccggccaccucaagugcagacugaaaauggauaaacuucgccugaagggggugagcuacucucucuguacagcugucugcaccgccgcuaaggugcccgccgaaacacugcauggaaccgugacgguugagguccaauaugcgggcaccgacgggccguguaaagugccugcccagauggcuguggacaugcagacacugacccccgucggacggcucaucacagccaauccugugauuaccgaauccacggagaacagcaagaugaugcuggaacuugauccucccuuuggcgacucuuacaucguuaucggggugggcgauaagaaaauuacacaccacuggcauagauccggaagcaccaucggcaaggcuuucgaggccacaguccgcggggcgaaacggauggccgugcugggagacaccgcuugggauuuuggcuccguugggggaguguucaacucucucggcaaggggauucaccaaaucuucggcgccgcuuuuaaaagccuguucggaggcauguccugguuuucucagauucugaucgggacccuucucgucuggcugggacugaauacaaagaacggcagcaucucccucacgugccuggcccuugggggagugaugauuuuccugagcaccgccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4621 - RNA, 2266 nt, Artificial Sequence
  KX601166.1 prME-short mRNA Design 1 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcacggaggcugugugaccgugauggcccaggacaaacccacagucgauaucgaacuugugaccaccacaguuagcaauauggcggaggugcggucuuacugcuacgaggccuccauuagcgacauggcuuccgauucucgcuguccuacgcaaggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccagcccgagaaucucgaauaucgcaucaugcuguccgugcacggaagccaacauucuggcaugauugucaacgacgagaauagagccaagguggaagucacgccuaacagcccgcgggccgaggcuacacuugggggauucggcucccugggccucgauugugagcccagaaccgggcuggacuuuucugaucuuuacuaucugaccaugaauaacaaacacuggcucgugcauaaggaaugguuccacgacaucccucugcccuggcacgcgggagccgauacaggcaccccucauuggaauaacaaagaggcucugguugaauuuaaggacgcccacgccaaacgccagacaguggucgugcucgggagccaggagggagcuguucauacggcccuggcgggcgcucuugaagccgagauggauggggccaagggccggcuguucuccggacaccucaagugcagacugaaaauggacaaacuucgccugaagggcgugagcuacucucucuguaccgcugccuuuacauucaccaagguccccgcugagacacugcaugggaccgugacgguggaaguucaguaugccggaaccgauggcccgugcaaagucccugcgcaaauggccguggacaugcagacacugacccccguggggcggcucauuacagcuaauccugucaucaccgaguccacggaaaacagcaagaugaugcuggagcuugacccucccuuuggagauucuuacauugugaucggcguuggggacaagaaaaucacacaccacuggcauagauccggcagcaccauuggaaaggccuucgaagcuacagugcgcggcgccaaacggauggcgguccugggggauaccgccugggacuucggauccgugggcgggguuuuuaacucucucggaaagggcauccaccagauuuucggggcugccuuuaaaagccuguucggcggaauguccugguuuucucaaauccugauuggcacccuucucguguggcuggggcugaauacaaagaacggaagcaucucccucacgugucuggcucuuggcggggucaugaucuuccugagcaccgccgugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4622 - RNA, 2284 nt, Artificial Sequence
  KF383118.1 prME-short mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaaccugaugacguggauuguuggugcaauaccacaucuaccuggguggucuacgggacgugucaccauaagaaaggagagaccagacggagccgcagauccgugucucuucgguaucacuacacacgcaagcugcaaaccagaagccagacauggcucgaaucccgggaguauaaaaagcaucugaucaugguugagaacuggaucuuucgcaauccgggcuucgccauugugagcgucgcuaucaccuggcugaugggcucucucacgucccagaaggugauuuaccugguuaugaucgugcuuauuguccccgccuacagcaucucuugcauugggguguccaacagagaccugguggaaggaaugagcggcgggacaugggucgauguugugcucgagcacggaggcugugugaccgaaauggcgcaggacaaaccuacagucgauaucgagcuggugaccaugaccguuucuaauauggccgaggugcgguccuauugcuacgaagcuagccuuuccgacauggccucugcuagccgcugucccacacaaggggagccuucccuggauaagcagagcgacacgcagucugucugcaaaagaacccucggagaccggggcuggggcaacggguguggaaucuuuggcaaggggucccuggugacaugcagcaaauuuaccugcuguaagaagaugcccggaaaaucuauucagccugaaaaucuggaguaucgcaucaugcucccgguucacggcagccaacauuccgggaugauugugaacgauaucggacacgaaacagacgagaauagagccaaggucgaggugacccccaacucuccucgggcggaagccacgcugggcggcuuugggagccuuggacuggauugcgagcccagaacaggccucgacuucuccgaucuguacuaucuuaccaugaauaacaaacauuggcugguccacaaggaaugguuucacgacauuccucuccccuggcaugcuggggccgauaccggaacaccgcacuggaauaacaaagaggcucugguggaguucaaggacgcccaugccaaacgccagaccguugugguccugggcagccaggaaggggcugugcacacagcgcucgccggcgcucuggaggccgaaauggauggagccaagggccggcuuuucucugggcaucugaaguguagacucaaaauggacaagcugcgccuuaaaggaguuuccuacagccugugcacggcugccuucaccuuuacaaaggugccugcggagacccuccacggcacagucaccguggaagugcagucugcugggacggauggacccuguaaaguuccugcccaaauggccgucgacaugcagacccugacacccgugggccggcugaucaccgcuaaucccgugaucacagaguccaccgaaaacagcaagaugaugcucgagcuggacccuccguucggggauuccuauauugucaucggcgugggagacaagaaaauuacgcaccauuggcacagaucuggcagcacaaucgggaaggccuuugaggcuaccguucgcggagccaaacggauggcggugcuuggcgauacagccugggacuucggguccgucggaggcguguucaacucucuggggaagggcauucaucagaucuuuggagcugccuucaaaagccucuuuggcgggauguccugguucagccaaauccugauuggaacccugcuuguuuggcucggccugaauaccaagaacgggucuaucucccugacaugccucgcucugggaggcgugaugauuuuucuuagcacggccgucucugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4623 - RNA, 2281 nt, Artificial Sequence
  KX447520.1 prME-short mRNA Design 1 opt
gggagaaagcuuaccaugagcgugggcaucgucgggcugcuccugaccacagccauggcugccgagguuacgagacggggauccgcguacuauauguaccuugaccgcaacgaugcuggcgaagccauuucuuuccccaccacacuggggaugaauaagugcuauauccagauuauggaccucggacacaugugugaugccaccaugagcuacgagugcccuaugcuggacgaaggcguggagccggaugacguggauuguuggugcaacacaaccuccacaugggucguguaugggaccugucaucacaaaaagggagaagcuagacggucucgcagagccguuacgcuucccagccauuccacccggaaacugcaaacacgcucucagaccuggcucgagagcagagaguacacaaagcaccugauccggguggaaaauuggauuuuucgcaacccuggcuucgcucuggccgcggccgcuaucgccuggcuccugggcuccagcaccucucagaaagucaucuaucuugugaugauucugcucaucgcucccgccuacuccauuagaugcaucgggguuagcaaucgggacuuuguggagggaaugucuggcgggacgugggucgauguggugcuggaacauggaggcugugucacaguuauggcgcaggacaagccuaccguggauauugagcuugugacaaccaccgucuccaacauggccgaggugcgcagcuacugcuaugaagccucuaucuccgacauggcuagcgauuccagaugucccacacaaggggaggcuuaccuggacaagcagucugacacgcaguauguuugcaaacggacccucguggaucgcggauggggcaauggcugugggcuguucggaaagggcagccuggucacaugcgccaaauuugccugcuccaagaaaaugaccggaaagagcauucagccugaaaaccucgaguacagaaucaugcugucugugcacgggucccaacacagcggcaugaucguuaaugacacagggcaugaaaccgaugagaaccgggcuaagguggagauuacgcccaauucucccagagcggaagccacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgcuggcgccgacacagggaccccgcauuggaacaauaaagaggcccugguggaauuuaaggaugcucacgccaaacggcagacagucgugguucucggaucucaggagggcgcggugcauacggcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacacugcauggaaccgugacgguugaagugcaguacgccggcaccgacgggccuugcaaaguccccgcucaaauggccguggacaugcagacacugaccccugugggaagacucaucacagcuaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggccuuugaagcgacagugagaggggccaaacggauggcuguccugggagauaccgccugggacuucggcuccguugggggagcucucaauucucugggcaaggggauucaccagaucuucggcgccgccuuuaaaagccuguucggaggcauguccugguuuucucaaauucuuaucgggacccuccugauguggcugggacucaacacaaagaauggcagcaucucccugaugugucuugcucuugggggagugcucauuuuccugagcacggcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4624 - RNA, 2284 nt, Artificial Sequence
  KU761561.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggcccggcgcauggcuguccugggagauaccgccugggacuucggcuccgucgggggagcucucaauucucugggcaaagggauucaccagaucuucggcgccgccuuuaagagccuguucggaggcauguccugguuuucucaaauucuuaucgggacacuccugauguggcugggacucaacacgaaaaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4625 - RNA, 2284 nt, Artificial Sequence
  KX806557.2 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauguuucgcaacccuggcuucgcucuggccgcggccgcuauugccuggcuccugggcuccagcacgucucagaaagucaucuaucuugugaugauccugcucauugcucccgccuacuccaucagaugcauugggguuagcaaucgggacuuuguggagggaaugucuggcgggacaugggucgauguggugcuggaacauggaggcugugucaccguuauggcgcaggacaagccuacaguggauaucgagcuugugaccaccacagucuccaacauggccgaggugcgcagcuacugcuaugaagcuagcauuuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaauuaugcugucugugcacggaucccaacacagcggcaugaucguuaaugacaccgggcaugaaacggaugagaaccgggcuaagguggagaucacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagaucccggcggagacccugcauggaacggugaccguugaagugcaguacgccggcacagacgggccuugcaaaguccccgcucaaauggccguggacaugcagacccugacaccugugggaagacucauuaccgcuaaccccguuaucacggaguccacagaaaacagcaagaugaugcuggagcuugaucccccuuucggcgacucuuacauugucaucggggugggcgagaaaaagaucacccaccacuggcaucgcuccggaagcacaauuggcaaggccuuugaagcgaccgugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuauugggacacuccugauguggcugggacucaacacgaagaauggcagcaucucccugaugugucuugcucuugggggaguucucaucuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4626 - RNA, 2284 nt, Artificial Sequence
  LC191864.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaugaccuccacaugggucguguaugggaccugucaucacaaaaagggagaagcuagacggucucgcagagccguuacgcuucccagccauuccacccggaaacugcaaacacgcucucagaccuggcucgagagcagagaguacacaaagcaccugauccggguggaaaauuggauuuuucgcaacccuggcuucgcucuggccgcggccgcuaucgccuggcuccugggcuccagcaccucucagaaagucaucuaucuugugaugauucugcucaucgcucccgccuacuccauuagaugcaucgggguuagcaaucgggacuuuguggagggaaugucuggcgggacgugggucgauguggugcuggaacauggaggcugugucacaguuauggcgcaggacaagccuaccguggauauugagcuugugacaaccaccgucuccaacauggccgaggugcgcagcuacugcuaugaagccucuaucuccgacauggcuagcgauuccagaugucccacacaaggggaggcuuaccuggacaagcagucugacacgcaguauguuugcaaacggacccucguggaucgcggauggggcaauggcugugggcuguucggaaagggcagccuggucacaugcgccaaauuugccugcuccaagaaaaugaccggaaagagcauucagccugaaaaccucgaguacagaaucaugcugucugugcacgggucccaacacagcggcaugaucguuaaugacacagggcaugaaaccgaugagaaccgggcuaagguggagauuacgcccaauucucccagagcggaagccacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgcuggcgccgacacagggaccccgcauuggaacaauaaagaggcccugguggaauuuaaggaugcucacgccaaacggcagacagucgugguucucggaucucaggagggcgcggugcauacggcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacacugcauggaaccgugacgguugaagugcaguacgccggcaccgacgggccuugcaaaguccccgcucaaauggccguggacaugcagacacugaccccugugggaagacucaucacagcuaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggccuuugaagcgacagugagaggggccaaacggauggcuguccugggagauaccgccugggacuucggcuccguugggggagcucucaauucucugggcaaggggauucaccagaucuucggcgccgccuuuaaaagccuguucggaggcauguccugguuuucucaaauucuuaucgggacccuccugauguggcugggacucaacacaaagaauggcagcaucucccugaugugucuugcucuugggggagugcucauuuuccugagcacggcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4627 - RNA, 2284 nt, Artificial Sequence
  KU744693.1 prME-short mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccgcgauggcccaggacaagccuacaguugauauugagcuugugaccaccacaguguccaacauggcugagguccgcagcuacugcuaugaagccucuaucuccgacauggcuagcgauuccagaugucccacgcaaggggaggccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauucagccugaaaaccucgaguacagaaucaugcugucuguccacggaucccaacacagcggcaugcuugugaaugacaccgggcaugaaacggaugagaaccgggcgaagguugagaucacaccgaauagccccagagccgaagcuacccugggaggcuucggcagccucgggcuggacugugagccucgcaccggacuugauuuuuccgaccuguauuaccucacaaugaacaauaaacacuggcuggcccauaaggaaugguuccacgauauuccccugccuuggcacgccggcgcugccaccgggacaccccauuggaacaauaaagaggcgcucguggaauuuaaggacgcucacgccaaacggcagacggucgugguccugggaucucaggagggcgccgugcauaccgcucuugccggggcucuggaggccgaaauggauggcgcgaagggaagacucagcuccggccaccugaaaugccgccuuaagauggacaagcugcggcucaaagggguuagcuauucucuguguacagccgcuuucaccuuuacaaagaucccggccgagaccguggauggaacggucaccguggaaggccaguacgggggaacagacggcccuugcaaaguucccgcucaaauggccguggacaugcagacccugacaccugucgggagacucauuaccgcgaaccccgugaucacggaguccacagaaaacagcaagaugaugcuggagcuugaucccccuuucggcgacucuuacauugugaucggaguuggcgagaaaaagaucacccaucacuggcaccgcuccgggagcacaauuggaaaggccuuugaagcuaccguccggggcgccaaaagaauggcugugcugggggauaccgccugggacuucggauccgugggcggggcccucaauucucugggcaagggaauccaucagauuaucggcgcugcguucaaaagccuguuugggggaauguccugguucucucaaauucuuaucggcacacuccugauguggcuggggcucaacacgaagaauggaagcaucucccugaugugucuugcccugggcgggguccucauuuuucugagcaccgcugugucuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4628 - RNA, 2275 nt, Artificial Sequence
  KU963574.2 prME-short mRNA Design 1 opt
gggagaaagcuuaccaugggcgccgacgcuagcaucgggauugugucccugcuccugaccacagucauggccgcggagaucacgagacggggaucugcuuacuauauguaccuugaucgcagcgacgccggcaaggccauuuccuucguuaccacacugggggugaacaaaugccacgugcagaucauggaucucggacauaugugugacgcuaccaugucuuaugaaugccccaugcuggaugagggcgucgaacccgacgauguggacuguuggugcaauacaaccagcacauggguuguguacgggaccugucaccauaagaaaggagaggccagacggucccgcagagcugucacgcuuccgucucacagcacccggaagcugcaaacacgcucccagaccuggcucgaaagcagagaguauacaaaacaucugauuaagguggagaacuggaucuuucggaaucccggcuucgcccugguugcgguggccaucgcuuggcuccugggaucuuccaccagccagaaggucauuuaccuugugaugauccugcucauugccccugcuuauucuauccgcugcauugggguguccaacagagauuuugucgaaggaaugagcggcgggacguggguugacguggugcuggagcacggaggcugugucacagugauggcccaggauaaacccaccguugacaucgaacuugugacaaccaccgucucuaauauggcggaggugcgguccuacugcuacgaggccagcauuuccgauauggcuucugacagccgcuguccuacacaaggggaagccuaucuggacaagcaguccgauacgcaguacguuugcaaaagaacccucguggaccggggauggggcaacggcugugggcuguucggaaagggcagccuggucacaugcgcuaaauuuaccugcucuaagaagaugacagggaaauccauccagcccgagaaucucgaauaucgcaucaugcugagcgugcacggaucucaacauagcggcaugauugucaacgaugagaauagagccaagguggaaguuaccccuaacuccccgcgggccgaggcuacgcuugggggauucggcucucugggccucgacugugagcccagaacagggcuggauuuuagcgaccuuuacuaucugaccaugaauaacaaacacuggcucgugcauaaggaaugguuccacgauaucccucugcccuggcacuccggagcggacaccgagacaccucauuggaauaacaaagaagcccuggucgaguuuaaggaugcucacgccaaacgccagaccgugguugugcucggcagccaggaaggggccguccauacagcucuggccggagcgcuugaggcugagauggacggcgccaaggggcggcugucuuccggccaccucaagugcagacugaaaauggauaaacuucgccugaagggagugagcuacucucucuguacggccgcuuucaccuuuacaaaggugcccgccgaaacccugcauggcacaguuaccgucgaggugcaguaugcugggcgggacggaccgugcaaagugccugcccaaauggcggucgacaugcagacgcugacccccgugggcagacucauuacagccaauccuguuaucaccgaauccacagagaacagcaagaugaugcuggaacuugauccucccuucggggacuccuacauugugaucggagucggcgauaagaaaaucacccaccacuggcaucgcucugggagcauuaucggcaaggcuuuugaggccacggugcggggagcuaaaagaauggccguucugggcgacacagcgugggauuucggguccgugggaggcgucuucaacucucucgggaagggcauucaccagaucuuuggcgccgcuuucaaaagccuguuugggggcauguccugguucagccaaauucugaucggaacccuucucguguggcugggccugaauacaaagaacgggucuaucucccucaccugucuggcccuuggaggcguuaugauuuuucugagcaccgcugugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4629 - RNA, 2293 nt, Artificial Sequence
  KF383120.1 prME-short mRNA Design 1 opt
gggagaaagcuuaccaugggcgccgacaccagcaucgggauuaucggacugcuccugacaacggcuauggccgcggagauuaccagacggggcuccgcuuacuauauguaccuugaucgcucugacgccgggaaggccaucagcuucgcuacaaccaugggagugaacaaaugccacguccagauuauggaucugggccauaugugugacgccacaauguccuaugaaugccccaugcucgaugaggggguugaaccugacgauguggacuguuggugcaauaccacaucuaccuggguggucuacggaacgugucaccauaagaaaggcgaggcuagaccgagccggcgcgccgugacccugcccucccacucuacaagaaaacuucaaacccggagccagacauggcuggaaucccgcgaguauaccaagcaucucaucaagguugagaacuggauccugagaaauccuggcuuuacgguggcggcccuggcuauggccuggcuccuggggaacagcacaucucagcgggucauuuaccuugugaugauccugcucauugcucccgccuauuccauccgcugcauuggaguuagcaauagagauuucguggaaggcaugucugggggaaccugggucgacguggugcuggagcacggcgggugugucacaguuauggcgcaggauaagccuaccguggacaucgaacuugugaccacaacggucuccaacauggccgaggugcggagcuacugcuacgaggcuucuauuuccgauauggccagcgacucccgcugucccacccaaggagaggcuuaucuggacaaacagucugauacacaguacguuugcaagagaacccucguggaccggggcuggggcaauggguguggacuguuuggcaaagggagccuggucacaugcgccaaguuuaccugcuccaaaaagaugacgggaaagagcauccagccugaaaaccucgaauaucgcaucaugcugucugugcacggcucccaacauagcgggaugauuguuaaugauaucggacacgagacagacgaaaacagagccaaaguggaggucacccccaauucuccccgggcugaggcgacccuuggcggcuucgggagccugggacucgauugugaaccuagaacaggccuggacuucuccgaucuuuacuaucugaccaugaacaauaagcauuggcucgugcacaaagagugguuucacgacauuccccugccuuggcaugccggggcugauacaggaacgccccacuggaacaauaaggaagcccuggucgaguucaaagacgcccaugcuaagcgccagaccgugguugugcucggcucucaggaaggggccguccacacagcgcuggcuggcgcccuugaggccgagauggauggagcuaaaggccggcuguuuagcgggcaucucaagugcagaaucaagauggacaaacugcgccuuaagggaguguccuacagccuguguaccgccgcuuucacauuuucuaaaguuccggccgaaacccuccacggcacggugaccgucgaggugcaguaugcggggcgggacggaccuugcaaggugcccgcccaaauggcuguugauaugcagacacugaccccugucggcagacugauuacagccaaccccaucaucaccgaauccacggagaacagccgcaugaugcucgaacuggacccgccuuucggggauucuuacauugugaucggcgugggagacaaaaagauuacacaccauuggcaccgguccggcagcaccaucgggaaggcuuuugaggccacagucagaggagcgaaacgcauggccgugcuuggcgauaccgcuugggacuucggguccguuggaggcguguucaauucucuggggaagggcguccaucagguguuuggagccgcuuucaaaagccucuuuggcgggauguccugguucucucaaauucugaucggaacccugcuuguuuggcucggccugaacacaaagaaugggagcaucucccuggccugucucgcccugggaggcgcuaugauuuuucuuagcacggcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4630 - RNA, 1576 nt, Artificial Sequence; identical to SEQ ID NO: 4405
  KU321639.1 solE mRNA Design 1 opt

SEQ ID NO: 4631 - RNA, 1576 nt, Artificial Sequence; identical to SEQ ID NO: 4406
  KU312312.1 solE mRNA Design 1 opt

SEQ ID NO: 4632 - RNA, 1564 nt, Artificial Sequence; identical to SEQ ID NO: 4407
  AY632535.2 solE mRNA Design 1 opt

SEQ ID NO: 4633 - RNA, 1576 nt, Artificial Sequence; identical to SEQ ID NO: 4406
  KU527068.1 solE mRNA Design 1 opt

SEQ ID NO: 4634 - RNA, 1576 nt, Artificial Sequence
  KX421193.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauacaggcuaugaaaccgacgagaaucgggccaagguggaagugacaccuaacagcccccgcgcugaggccacccucgggggauuuggcucucugggccuggauugcgagccuagaacggggcuugacuucuccgaucuguacuaccucacaaugaauaacaaacauuggcugguccacaaggaaugguuucaugacauuccccuuccuuggcacgcgggagccgacaccggcacaccgcacuggaauaacaaagaggcucugguggaguucaaggaugcccaugcuaagcggcagaccguugugguccucgggagccaggaaggagccgugcacaccgcgcuggccggcgcucuggaagccgagauggacggggcuaaaggaaagcucuuuuccggccaucugaaaugucgccuuaagauggauaaacugagacucaagggcguuucuuauagccugugcacagccgccuucacguuuaccaaagugcccgcugagacacuucacgggaccgucacaguggaaguccaauacgcgggaaccgacggcccuuguaagauccccgugcagauggccguugauaugcagacgcugacaccuguggggcggcucauuaccgcuaaucccgucaucaccgaguccacagaaaacagcaagaugaugcuggagcuggacccgccuuucggagauucuuauauugugaucggcguuggggacaaaaagaucacccaccauuggcaccgcuccggcagcacaauuggaaaagccuuugaagccacggugagaggcgcuaagcggauggccguccucggggauaccgcgugggacuucggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4635 - RNA, 1576 nt, Artificial Sequence
  LC002520.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugacaguuaacgauaucggcuaugaaaccgacgagaaucgggccaagguggaagugacaccuaacagcccccgcgcugaggccacccucgggggauuuggcucucugggccuggauugcgagccuagaacggggcuugacuucuccgaucuguacuaccucacaaugaauaacaaacauuggcugguccacaaggaaugguuucaugacauuccccuuccuuggcacgcgggagccgacaccggcacaccgcacuggaauaacaaagaggcucugguggaguucaaggaugcccaugcuaagcggcagaccguugugguccucgggagccaggaaggagccgugcacaccgcgcuggccggcgcucuggaagccgagauggacggggcuaaaggaaagcucuuuuccggccaucugaaaugucgccuuaagauggauaaacugagacucaagggcguuucuuauagccugugcacagccgccuucacguuuaccaaagugcccgcugagacacuucacgggaccgucacaguggaaguccaauacgcgggaaccgacggcccuuguaagauccccgugcagauggccguugauaugcagacgcugacaccuguggggcggcucauuaccgcuaaucccgucaucaccgaguccacagaaaacagcaagaugaugcuggagcuggacccgccuuucggagauucuuauauugugaucggcguuggggacaaaaagaucacccaccauuggcaccgcuccggcagcacaauuggaaaagccuuugaagccacggugagaggcgcuaagcggauggccguccucggggauaccgcgugggacuucggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4636 - RNA, 1558 nt, Artificial Sequence
  DQ859059.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgaugaaaaucgggccaagguggaggugacaccuaacagcccccgcgcugaagccacccugggcggguuuggaucucucggccuggacugcgagccuagaacaggccuugauuucuccgaccuguauuaccucaccaugaauaacaaacauuggcugguccacaaggagugguuucaugauauuccccuuccuuggcacgcgggggccgacacgggaacaccgcacuggaauaacaaagaagcucugguggaguucaaggacgcccaugcuaagcggcagaccguugugguccucggcagccaggaaggggccgugcacacagcgcuggccggagcucuggaggccgaaauggauggcgcuaaagggcgccucuuuuccggacaucugaaguguagacuuaaaauggacaagcugcggcucaaaggcguuucuuacagccugugcaccgccgccuucaccuuuacaaaggugcccgcugagacgcuucacggcaccgucacaguggagguccaauaugcggggaccgauggaccuuguaaagugcccgcccagauggcuguugacaugcagacacugaccccugugggccgccucaucacggccaaucccgucauuacagaauccaccgagaacagcaagaugaugcuggaacuggauccgccuuucggggacucuuacaucgugauuggaguuggcgauaagaaaaucacccaccauuggcacagauccgggagcacaaucggcaaggccuuugaggcuaccgugcggggagccaaacgcauggcgguccucggcgacacagcuugggauuucgggucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4637 - RNA, 1564 nt, Artificial Sequence
  KU963573.2 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucggcuaugaaacagaugagaaccgggccaagguugaagugaccccuaauagcccccgcgcugaggccacacucgggggauuuggcucucugggccuggacugcgagccuagaaccgggcuugauuucuccgaccuguacuaccucacgaugaacaauaaacauuggcuggugcacaaggaaugguuucaugauauuccccuuccuuggcacgcgggagccgacacaggcaccccgcacuggaacaauaaagaggcucuggucgaguucaaggacgcccaugcuaagcggcagacagugguugugcucgggagccaggaaggagccguccacaccgcgcuggccggcgcucuggaagccgagauggauggggcuaaaggaaagcucuuuuccggccaucugaaaugucgccuuaagauggacaaacugagacucaagggcgugucuuauagccugugcaccgccgccuucacauuuacgaaaguucccgcugagacccuucacgggacagugaccgucgaagugcaauacgcgggaacagauggcccuuguaagauccccguccagauggccguggacaugcagacccugacgccuguugggcggcucauuacagcuaaccccgugaucaccgaguccaccgaaaauagcaagaugaugcuggagcuggauccgccuuucggagacucuuauauugucaucggcgugggggauaaaaagaucacacaccauuggcaccgcuccggcagcaccauuggaaaagccuuugaagccacaguuagaggcgcuaagcggauggccgugcucggggacacggcgugggauuucggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4638 - RNA, 1576 nt, Artificial Sequence
  KY075939.1 solE mRNA Design 1 opt
gggagaaagcuuaccaugagccagaaggugaucuaccuggucaugauucuccugaucgcccccgcuuauucccuuagaugcauuggcguuucuaaccgggacuucguggaggggaugagcggaggcaccuggguggaugucgugcuggaacacgggggauguguuacagugauggcccaagacaaaccuacggucgauaucgagcucgugaccacaaccguuuccaauauggcggaagugcgcucuuacugcuaugaggcuagcauuuccgacauggccucugauagcagauguccgacacagggcgaagccuaccuggacaagcaguccgauacccaguaugucugcaaacggacacuuguggaccgcggguggggaaacggcuguggccuguuugggaagggaagccucgugaccugcgcuaaauucgccuguucuaagaagaugacgggcaaauccauccaacccgagaaucuggaguacagaaucaugcugagcguccaugggucucagcacuccggaaugauuguuaacgauaccggccaugaaacagacgagaaucgggcuaagguggaaaucaccccuaacagcccccgcgccgaggcgacacucgggggauuuggcucucugggccuugauugcgagccuagaaccgggcuggacuucuccgaucucuauuaccugacgaugaauaacaaacacuggcuugugcauaaggaaugguuucacgacauuccccugccuuggcacgccggagcugacacaggcaccccgcauuggaauaacaaagaggcccucgucgaguucaaggaugcucacgccaagcggcagacagugguugugcuggggagccaggaaggagcgguccauaccgcccuggcuggcgcccucgaagcugagauggacggggccaaaggacgccuguccucuggccaccuuaaguguagacugaaaauggauaagcuccggcugaaaggcgugagcuacucccuuugcaccgccgcuuuuacauucacgaagauccccgcggagacccugcacgggacaguuaccguggaaguccaauaugccggaacagacggcccuuguaaagugcccgcucagauggccgucgauaugcagacccucacgccuguggggcgccugauuacagccaaucccguuaucaccgagagcaccgaaaacucuaagaugaugcuggagcucgacccgccuuuuggagauuccuacauugugaucggcgucggggaaaagaaaaucacacaucacuggcauagaagcggcucuaccauuggaaaggcuuucgaggccacagugcggggcgcgaaacgcauggcuguucugggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4639 - RNA, 1576 nt, Artificial Sequence
  KX447516.1 solE mRNA Design 1 opt
gggagaaagcuuaccaugagcaagaaagugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaggacaagccuacggucgauauugagcuggugaccacaaccguuuccaauauggcggaagugcgcucuuacugcuaugaggcuagcaucuccgacauggccucugauagcagauguccgacacaaggcgaagccuaccucgacaaacaguccgauacccaguaugucugcaagcggacacugguggaccgcggguggggaaacggcuguggccuuuuugggaaaggaagccuggugaccugcgcuaaguucgccuguucuaagaaaaugacgggcaaguccauccagcccgagaaucucgaguacagaauuaugcugagcguccaugggucucaacacuccggaaugaucguuaacgauaccggccaugaaacagacgagaaucgggcuaaaguggaaauuaccccuaacagcccccgcgccgaggcgacacucgggggauuuggcucucugggccuggauugcgagccuagaaccgggcuugacuucuccgaucuguauuaccucacgaugaauaacaagcacuggcuggugcauaaagaaugguuucacgacaucccccuuccuuggcacgccggagcugacacaggcaccccgcauuggaauaacaaggaggcccuggucgaguucaaggaugcucacgccaaacggcagacagugguugugcucgggagccaggaaggagcgguccauaccgcccuggcuggcgcccuggaagcugagauggacggggccaagggacgccucuccucuggccaccugaaauguagacuuaagauggauaaacugcggcucaagggcgugagcuacucccugugcaccgccgcuuuuacauucacgaaaauucccgcggagacccuucacgggacaguuaccguggaaguccaguaugccggaacagacggcccuuguaaggugcccgcucaaauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggagaaaaagauuacacaucacuggcauagaagcggcucuaccaucggaaaggcuuucgaagccacagugcggggcgcgaaacgcauggcuguucucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4640 - RNA, 1576 nt, Artificial Sequence
  KX447515.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacugguauagaagcggcucuaccaucggaaaggcuuucgaggccacagugcggggcgcgaaacgcauggcuguucucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4641 - RNA, 1576 nt, Artificial Sequence
  KU758874.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggaaagcucuccucuggccaccugaaaugucgccuuaagauggauaaacugagacucaagggcgugagcuacucccugugcaccgccgcuuuuacauucacgaaaauucccgcggagacccuucacgggacaguuaccguggaaguccaauaugccggaacagacggcccuuguaaggugcccgcucagauggccgucgauaugcagacccugacgccuguggggcggcucaucacagccaaucccguuauuaccgagagcaccgaaaacucuaagaugaugcuggagcuggacccgccuuuuggagauuccuacaucgugaucggcgucggggagaaaaagauuacacaucacuggcaucgcagcggcucuaccaucggaaaggcuuucgaagccacagugagaggcgcgaaacggauggcuguucucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4642 - RNA, 1576 nt, Artificial Sequence
  KU729218.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauacccagacgcugacaccuguggggcgccucaucaccgccaaucccguuauuaccgagagcacagaaaacucuaagaugaugcuggagcuggacccgccuuuuggagauuccuacaucgugaucggcgucggggaaaagaaaauuacccaucacuggcauagaagcggcucuacaaucggaaaggcuuucgaggccacggugcggggcgcgaaacgcauggcuguucucggggacaccgccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4643 - RNA, 1576 nt, Artificial Sequence
  KU501217.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaaauccgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccugguggaguucaaggaugcucacgccaagcggcagacagucgugguucucgggagccaggaaggagcggugcauaccgcccuggcuggcgcccuggaagcugagauggacggggccaaaggacgccucuccucuggccaccugaaguguagacuuaaaauggauaagcugcggcucaaaggcgucagcuacucccugugcaccgccgcuuuuacauucacgaagauccccgcggagacccuucacgggacagugaccguugaagugcaauaugccggaacagacggcccuuguaaaguccccgcucagauggccguggauaugcagacccugacgccugucgggcgccucauuacagccaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggcuuucgaggccacaguccggggcgcgaaacgcauggcugugcucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4644 - RNA, 1576 nt, Artificial Sequence
  KU761561.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacuggcauagaagcggcucuaccaucggaaaggcuuucgaggccacagugcggggcgcgcgcagaauggcuguucucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4645 - RNA, 1576 nt, Artificial Sequence
  KY075937.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggucucugauagcagauguccgacacagggcgaagccuaccucgacaagcaguccgauacccaguaugugugcaaacggacacugguggaccgcggguggggaaacggcuguggccuuuuugggaagggaagccugguuaccugcgccaaauucgcuuguucuaagaagaugacgggcaaauccauccaacccgagaaucucgaguacagaauuaugcugagcguccaugggucucagcacuccggaaugaucgugaacgauaccggccaugaaacagacgagaaucgggccaagguggaaauuaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuccucuggccaccugaaguguagacuuaaaauggauaagcugcggcucaaaggcguuagcuacucccugugcaccgccgccuuuacauucacgaagauucccgcugagacccuucacgggacagugaccgucgaagugcaauaugcgggaacagacggcccuuguaaaguccccgcccagauggcuguggauaugcagacccugacgccuguugggcgccucaucacagccaaucccgugauuaccgagagcaccgaaaacucuaagaugaugcuggagcuggacccgccuuuuggagauuccuacaucgucaucggcgugggggaaaagaaaauuacacaucacuggcauagaagcggcucuaccaucggaaaggccuucgaggcuacaguucggggcgccaaacgcauggcggugcucggggacacggcuugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4646 - RNA, 1576 nt, Artificial Sequence
  KY014317.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaucgaaaacucuaagaugaugcuggagcuggacccgccuuuuggagauuccuacaucgugauuggcgucggggaaaagaaaaucacccaucacuggcauagaagcggcucuacaauuggaaaggcuuucgaggccaccgugcggggcgcgaaacgcauggcuguucucggggacacagccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4647 - RNA, 1576 nt, Artificial Sequence
  KU870645.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcauuggggaaaagaaaaucacacaucacuggcauagaagcggcucuaccauuggaaaggcuuucgaggccacaguccggggcgcgaaacgcauggcugugcucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4648 - RNA, 1576 nt, Artificial Sequence
  KU922923.1 solE mRNA Design 1 opt
gggagaaagcuuaccaugagccagaaggugaucuaccuggucaugauucuccugaucgcccuugcuuauuccauuagaugcaucggcguuucuaaccgggacuucguggaggggaugagcggaggcaccuggguggaugucgugcuggaacacgggggauguguuacagugauggcccaagacaaacccacggucgauauugagcucgugaccacaaccguuuccaauauggcggaagugcgcucuuacugcuaugaggcuagcaucuccgacauggccucugauagcagauguccuacacagggcgaagccuaccuggacaagcaguccgauacccaguaugucugcaaacggacacuuguggaccgcggguggggaaacggcuguggccuguuugggaagggaagccucgugaccugcgcuaaauucgccuguucuaagaagaugacgggcaaauccauccaaccggagaaucuggaguacagaauuaugcugagcguccaugggucucagcacuccggaaugaucguuaacgauaccggccaugaaacagacgagaaucgggcuaagguggaaauuacccccaacagcccucgcgccgaggcgacacucgggggauuuggcucucugggccuugauugcgagcccagaaccgggcuggacuucuccgaucucuauuaccugacgaugaauaacaaacacuggcuugugcauaaggaaugguuucacgacaucccucugcccuggcacgccggagcugacacaggcaccccucauuggaauaacaaagaggcccucgucgaguucaaggaugcucacgccaagcggcagacagugguugugcuggggagccaggaaggagcgguccauaccgcccuggcuggcgcccucgaagcugagauggacggggccaaaggacgccuguccucuggccaccuuaaguguagacugaaaauggauaagcuccggcugaaaggcgugagcuacucccuuugcaccgccgcuuuuacauucacgaagauuccggcggagacccugcacgggacaguuaccguggaaguccaauaugccggaacagacggccccuguaaagugccugcucagauggccgucgauaugcagacccucacgcccguggggcgccugaucacagccaauccuguuauuaccgagagcaccgaaaacucuaagaugaugcuggagcucgaucccccguuuggagacuccuacaucgugaucggcgucggggaaaagaaaauuacacaucacuggcauagaagcggcucuaccaucggaaaggcuuucgaggccacagugcggggcgcgaaacgcauggcuguucugggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4649 - RNA, 1576 nt, Artificial Sequence
  KU497555.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggacccaggaaggagcgguccauaccgcccuggcuggcgcccuggaagcugagauggacggggccaaaggacgccucagcuccggccaccugaaguguagacuuaaaauggauaagcugcggcucaaaggcgugucuuacagccugugcacagccgcuuuuacguucaccaagauucccgcggagacacuucacgggaccguuacaguggaaguccaauaugccggaaccgacggcccuuguaaagugcccgcucagauggccgucgauaugcagacgcugacaccuguggggcgccucaucaccgccaaucccguuauuaccgaguccacagaaaacagcaagaugaugcuggagcuggacccgccuuuuggagauucuuacaucgugaucggcgucggggaaaagaaaauuacccaucacuggcauagauccggcagcacaaucggaaaggcuuucgaggccacggugcggggcgcgaaacgcauggcuguucucggggacaccgccugggauuuuggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4650 - RNA, 1576 nt, Artificial Sequence
  KU312314.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcuggcucagauggccgucgauaugcagacccucacgcccguggggcgccugaucacagccaauccuguuauuaccgagagcaccgaaaacucuaagaugaugcuggagcucgaucccccguuuggagacuccuacaucgugaucggcgucggggaaaagaaaauuacacaucacuggcauagaagcggcucuaccaucggaaaggcuuucgaggccacagugcggggcgcgaaacgcauggcuguucugggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4651 - RNA, 1576 nt, Artificial Sequence
  KY014314.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaagcucacgccaagcggcagacagugguugugcucgggagccaggaaggagcgguccauaccgcccuggcuggcgcccuggaggcugagauggauggggccaaaggacgccucuccucuggccaccugaaguguagacuuaaaauggacaagcugcggcucaaaggcgugagcuacucccugugcaccgccgcuuuuacauucacgaagauucccgcggaaacccuucacgggacaguuaccguggagguccaauaugccggaacagauggcccuuguaaagugcccgcucagauggccgucgacaugcagacccugacgccuguggggcgccucaucacagccaaucccguuauuaccgaaagcaccgagaacucuaagaugaugcuggaacuggauccgccuuuuggagacuccuacaucgugaucggcgucggggagaagaaaauuacacaucacuggcauagaagcggcucuaccaucggaaaggcuuucgaggccacagugcggggcgcgaaacgcauggcuguucucggggauacggccugggacuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4652 - RNA, 1576 nt, Artificial Sequence
  KX447517.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcggcccucgggggauuuggcucucugggccuggauugcgagccuagaacagggcuugacuucuccgaucuguauuaccucaccaugaauaacaaacacuggcuggugcauaaggaaugguuucacgacaucccccuuccuuggcacgcuggagccgacacgggcacaccgcauuggaauaacaaagaggcucuggucgaguucaaggaugcccacgcgaagcggcagaccgugguugugcucgggagccaggaaggagccguccauacagcucuggccggcgcucuggaagccgagauggacggggccaaaggacgccucuccucuggccaccugaaguguagacuuaaaauggauaagcugcggcucaaaggcgugagcuacucccugugcaccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4653 - RNA, 1576 nt, Artificial Sequence
  KU729217.2 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcugguguccaccacaguuucuaauauggcggaagugcgcagcuacugcuaugaggcuaccaucuccgacaucgccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauucaacccgagaaucucgaguacagaaucaugcugagcguccaugggucucagcacuccggaaugauuguuaacgauaccggccaugaaacagacgagaaucgggcuaagguggaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccuggucgaguucaaggaugcucacgccaagcggcagacagcggugguucucgggagccaggaaggagccgugcauaccgcucuggccggcgcucuggaagccgagauggacggggccaaaggacgccucuccucuggccaccugaaguguagacuuaaaauggauaagcugcggcucaaaggcgucagcuacucccugugcaccgcugcguuuacauucacgaagauccccgccgagacccuucacgggacagugaccguugaagugcaauaugcuggaacagacggcccuuguaaaguccccgcccagauggccguggauaugcagacccugacgccugucgggcgccucauuacagcuaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggccuucgaggcgacaguccggggcgcuaaacgcauggccgugcucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4654 - RNA, 1576 nt, Artificial Sequence
  KY328290.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucagcaagauucccgcggagacgcuucacgggaccguuacagaagaggugcaauaugccggaaccgacggcccuuguaaaguccccgcucagauggccguggauaugcagacacugaccccugucgggcgccucaucacggccaaucccgugauuacagaaucuaccgagaacuccaagaugaugcuggaacuggacccgccuuuuggagauagcuacaucguuaucggcgugggggagaagaaaauuacccaucacuggcauagaucuggcagcacaaucggaaaggcuuucgaggccaccguccggggcgcgaaacgcauggcugugcucggggacacagccugggauuuuggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4655 - RNA, 1576 nt, Artificial Sequence
  KX087101.3 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaacugcaauaugccggaacagacggcccuuguaaaguccccgcucagauggccguggauaugcagacccucacgccugucgggcgccugaucacagccaaucccgugauuaccgagagcaccgaaaacucuaagaugaugcuggagcucgacccgccuuuuggagauuccuacaucguuaucggcgugggggaaaagaaaauuacacaucacuggcauagaagcggcucuaccaucggaaaggcuuucgaggccacaguccggggcgcgaaacgcauggcugugcugggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4656 - RNA, 1576 nt, Artificial Sequence
  KY003156.1 solE mRNA Design 1 opt
gggagaaagcuuaccaugagccagaaggugaucuaccuggucaugauucuccugaucgcccccgcuuauuccauuagaugcaucggcauuucuaaccgggacuucguugaggggaugagcggaggcaccuggguggaugugguccuugaacacgggggaugugugacaguuauggcccaagacaaaccuacgguggauaucgagcuggucaccacaaccguguccaauauggcggaaguucgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcauucugggccuggauugcgagccuagaaccgggcuugacuucucugaucuguauuaccucacgaugaauaacaaacacuggcuggugcauaaggaaugguuucacgacaucccccuuccuuggcacgccggagcugacacaggcaccccgcauuggaauaacaaagaggcccugguggaguucaaggaugcucacgccaagcggcagacagucgugguucucgggucccaggaaggagcggugcauaccgcccuggcuggcgcccuggaagcugagauggacggggccaaaggacgccucagcuccggccaccugaaguguagacuuaaaauggauaagcugcggcucaaaggcgucucuuacagccugugcaccgccgcuuuuacauucacgaagauucccgcggagacccuucacgggacagugaccguugaagugcaauaugccggaacagacggcccuuguaaaguccccgcucagauggccguggauaugcagacccugacgccugucgggcgccucaucacagccaaucccgugaucaccgaguccaccgaaaacagcaagaugaugcuggagcuggacccgccuuuuggagauucuuacauuguuaucggcgugggggaaaagaaaauuacacaucacuggcauagauccggcagcaccaucggaaaggcuuucgaggccacaguccggggcgcgaaacgcauggcugugcucggggacacggccugggauuuuggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4657 - RNA, 1576 nt, Artificial Sequence
  KU758876.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggugaaaggacgccucuccucuggccaccugaaguguagacuuaaaauggauaagcugcggcucaaaggcguuagcuacucccugugcaccgccgccuuuacauucacgaagauucccgcugagacccuucacgggacagugaccgucgaagugcaauaugcgggaacagacggcccuuguaaaguccccgcccagauggcuguggauaugcagacccugacgccuguugggcgccucaucacagccaaucccgugauuaccgagagcaccgaaaacucuaagaugaugcuggagcuggacccgccuuuuggagauuccuacaucgucaucggcgugggggaaaagaaaauuacacaucacuggcauagaagcggcucuaccaucggaaaggccuucgaggcuacaguucggggcgccaaacgcauggcggugcucggggacacggcuugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4658 - RNA, 1576 nt, Artificial Sequence
  KU926310.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggagcugacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4659 - RNA, 1576 nt, Artificial Sequence
  KU681081.3 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacacaggagccgacaccggcacaccgcauuggaauaacaaagaggcucuggucgaguucaaggaugcccacgcuaagcggcagaccgugguugugcucgggagccaggaaggagccguccauaccgcgcuggccggcgcucuggaagccgagauggacggggcuaaaggacgccucuccucuggccaccugaaguguagacuuaaaauggauaagcugcggcucaaaggcgugagcuacucccugugcacagccgccuuuacguucaccaagauucccgcugagacacuucacgggaccguuacaguggaaguccaauaugcgggaaccgacggcccuuguaaagugcccgcccagauggcugucgauaugcagacgcugacaccuguggggcgccucaucaccgccaaucccguuauuaccgagggaacagaaaacagcaagaugaugcuggagcuggacccgccuuuuggcgauucuuacaucgugaucggggucggcgaaaagaaaauuacccaucacuggcauagauccggaagcacaaucggcaaggccuucgaggcuacggugcgcggggccaaacggauggcgguucucggagacaccgcuugggauuuuggcucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4660 - RNA, 1576 nt, Artificial Sequence
  KU744693.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagccauggcgcaagacaaaccuacgguggauauugagcuggucaccacaaccguguccaauauggcugaaguucgcucuuacugcuaugaggccagcaucuccgacauggccucugauagcagauguccgacacagggcgaggcuuaccucgacaagcaguccgauacccaguaugugugcaaacggacacuggucgaccgcggguggggaaacggcuguggccuuuuugggaagggaagccuggugaccugcgccaaauucgcuuguucuaagaagaugacgggcaaauccauccaacccgaaaaucucgaguacagaauuaugcugagcgugcaugggucucagcacuccggaaugcuggucaacgauaccggccaugaaacagacgagaaucgggccaagguugaaaucaccccuaacagcccccgcgcggaggccacacucgggggauuuggcucucugggccuugauugcgagccuagaaccgggcuggacuucuccgaucucuauuaccugacgaugaauaacaaacacuggcuugcucauaaggaaugguuucacgacauuccccugccuuggcacgccggagcugccacaggcaccccgcauuggaauaacaaagaggcgcucguggaguucaaggacgcccacgcuaagcggcagacaguggucgugcuggggagccaggaaggagccguucauaccgcucuggccggcgcccucgaagcugagauggauggggcgaaaggacgccuguccucuggccaccuuaaguguagacugaaaauggacaagcuccggcugaaaggcgugagcuacucccuuugcaccgccgcuuuuacauucacgaagauccccgccgagaccgucgaugggacagugaccguugaaggacaauauggcgggacagacggaccuuguaaagugcccgcccagauggcugucgauaugcagacccugacgccugugggccgccucauuacagccaaucccgucaucaccgagagcaccgaaaacucuaagaugaugcuggagcuggacccgccuuuuggggauuccuacauugugaucggcguuggagaaaagaaaaucacacaccauuggcacagaagcggcucuaccauugggaaggcguucgaggcuacagugcggggagccaaacgcauggccguccucggcgacacggcuugggauuuugggagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4661 - RNA, 1576 nt, Artificial Sequence
  EU545988.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccugcggucgauauugagcuggugacgaccacaguuuccaauauggcugaagugcgcucuuacugcuaugaggccagcaucuccgacauggccucugauagcagauguccgacccagggcgaggcuuaccucgacaagcaguccgauacacaguaugucugcaaacggacccugguggaccgcggguggggaaacggcuguggccuuuuugggaagggaagccuggugacaugcgccaaauucgcuuguucuaagaagaugaccggcaaauccauccaacccgaaaaucucgaguacagaauuaugcugagcguccaugggucucagcacuccggaaugaucguuaacgauacgggccaugaaaccgacgagaaucgggccaagguggaaauuacaccuaacagcccccgcgcggaggccacccucgggggauuuggcucucugggccuggauugcgagccuagaacagggcuugacuucuccgaucuguauuaccucaccaugaauaacaaacacuggcuggugcauaaggaaugguuucacgacaucccccuuccuuggcacgcuggagccgacacgggcacaccgcauuggaauaacaaagaggcucuggucgaguucaaggaugcccacgcgaagcggcagaccgugguugugcucgggagccaggaaggagccguccauacagcucuggccggcgcucuggaagccgagauggacggggccaaaggacgccucuccucuggccaccugaaguguagacuuaaaauggauaagcugcggcucaaaggcgugagcuacucccugugcaccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4662 - RNA, 1576 nt, Artificial Sequence
  KY007221.1 solE mRNA Design 1 opt
gggagaaagcuuaccaugagccagaaggugaucuaccuggucaugauucuccugaucgcccccgcuuauuccauuagaugcaucggcguuaacaaucgggacuucguggaggggaugucuggaggcaccuggguggaugucgugcuugaacacgggggauguguuacagugauggcccaagacaaaccuacggucgauauugagcuggugaccacaaccguuagcaacauggcggaagugcgcuccuacugcuaugaggcuucuaucagcgacauggccuccgauucuagauguccgacacagggcgaagccuaccucgacaagcagagcgauacccaguaugucugcaaacggacacugguggaccgcggguggggaaauggcuguggccuuuuugggaagggaucccuggugaccugcgcuaaauucgccuguagcaagaagaugacgggcaaaucuauccaacccgagaaccucgaguacagaauuaugcuguccguccaugggagccagcacucuggaaugaucguuaaugauaccggccaugaaacagacgagaaccgggcuaagguggaaauuaccccuaauagcccccgcgccgaggcgacacucgggggauuuggcucccugggccuggauugcgagccuagaaccgggcuugacuucucugaucuguauuaccucacgaugaacaauaaacacuggcuggugcauaaggaaugguuucacgacaucccccuuccuuggcacgccggagcugacacaggcaccccgcauuggaacaauaaagaggcccuggucgaguucaaggaugcucacgccaagcggcagacagugguugugcucgggucccaggaaggagcgguccauaccgcccuggcuggcgcccuggaagcugagauggacggggccaaaggacgccucagcuccggccaccugaaguguagacuuaaaauggauaagcugcggcucaaaggcgugucuuacagccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaccccguuauuaccgaguccaccgaaaauagcaagaugaugcuggagcuggacccgccuuuuggagauucuuacaucgugaucggcgucggggaaaagaaaauuacacaucacuggcauagauccggcagcaccaucggaaaggcuuucgaggccacagugcggggcgcgaaacgcauggcuguucucggggacacggccugggauuuuggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4663 - RNA, 1576 nt, Artificial Sequence
  KY003152.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcgccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4664 - RNA, 1576 nt, Artificial Sequence
  KX694533.2 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauauuggccaugaaaccgacgagaaucgggcuaagguggaaaucacaccuaacagcccccgcgccgaggcgacccucgggggauuuggcucucugggccuggauugcgagccuagaacagggcuugacuucuccgaucuguauuaccucaccaugaauaacaaacacuggcuggugcauaaggaaugguuucacgacauuccccuuccuuggcacgccggagcugacacgggcacaccgcauuggaauaacaaagaggcccuggucgaguucaaggaugcucacgccaagcggcagaccgugguugugcucgggagccaggaaggagcgguccauacagcccuggcuggcgcccuggaagcugagauggacggggccaaaggacgccucuccucuggccaccugaaguguagacuuaaaauggauaagcugcggcucaaaggcgugagcuacucccugugcaccgccgcuuuuaccuucacaaagauccccgcggagacgcuucacgggaccguuacaguggaaguccaauaugccggaaccgacggcccuuguaaagugcccgcucagauggccgucgauaugcagacacugaccccuguggggcgccucauuacggccaaucccguuaucacagagagcaccgaaaacucuaagaugaugcuggagcuggacccgccuuuuggagauuccuacaucgugauuggcgucggggacaagaaaaucacccaucacuggcauagaagcggcucuacaauuggaaaggcuuucgaagccaccgugcggggcgcgaaacgcauggcuguucucggggauacagccugggacuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4665 - RNA, 1576 nt, Artificial Sequence
  KX601167.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggacaagaaaauuacacaucacugguauagaagcggcucuaccaucggaaaggcuuucgaagccacagugcggggcgcgaaacgcauggcuguucucggggauacggccugggacuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4666 - RNA, 1576 nt, Artificial Sequence
  KY288905.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauacaggccaugaaaccgacgagaaucgggccaagguggaagugacaccuaacagcccccgcgcugaggccacccucgggggauuuggcucucugggccuggauugcgagccuagaacggggcuugacuucuccgaucuguauuaccucacaaugaauaacaaacacuggcugguccauaaggaaugguuucacgacauuccccuuccuuggcacgcgggagccgacaccggcacaccgcauuggaauaacaaagaggcucugguggaguucaaggaugcccacgcuaagcggcagaccguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcacagccgccuucacguuuaccaaggugcccgcugagacacuucacgggaccgucacaguggaaguccaauaugcgggaaccgacggcccuuguaaagugcccgcccagauggcuguugauaugcagacgcugacaccuguggggcgccucaucaccgccaaucccgucauuaccgaguccacagaaaacagcaagaugaugcuggagcuggacccgccuuucggagauucuuacaucgugauuggcguuggggacaagaaaaucacccaucacuggcauagauccggcagcacaaucggaaaggccuuugaagcuacggugcggggcgccaaacgcauggcgguccucggggauaccgcuugggacuucggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4667 - RNA, 1576 nt, Artificial Sequence
  KF268950.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauauuggccaugaaacagacgagaaucgggccaagguggaagugaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcaccgccgccuucacauuuacgaaggugcccgcugagacccuucacgggacagucaccguggaaguccaauaugcgggaacagacggcccuuguaaagugcccgcccagauggcuguugauaugcagacccugacgccuguggggcgccucauuacagccaaucccgucaucaccgaguccaccgaaaacagcaagaugaugcuggagcuggacccgccuuucggagauucuuacauugugaucggcguuggggacaagaaaaucacacaucacuggcauagauccggcagcaccauuggaaaggccuuugaagcuacagugcggggcgccaaacgcauggcgguccucggggauacggcuugggacuucggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4668 - RNA, 1576 nt, Artificial Sequence
  KF383116.1 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauauuggccaugaaacagacgagaaucgggccaagguggaagugaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcaccgccguguguacagccgcuaagguccccgcggagacgcuucacgggaccgugacagucgaagugcaauaugccggaaccgacggcccuugcaaaguucccgcucagauggccguggauaugcagacacugaccccugucgggcgccucauuacggccaaucccgugaucacagaguccaccgaaaacagcaagaugaugcuggagcuggacccgccuuucggagauucuuacauuguuaucggcgugggggacaagaaaaucacccaucacuggcauagauccggcagcacaauuggaaaggcuuuugaagccaccguccggggcgcgaaacgcauggcugugcucggggauacagccugggacuucggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4669 - RNA, 1558 nt, Artificial Sequence
  KU963574.2 solE mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgaugaaaaucgggccaagguggaggugacaccuaacagcccccgcgcugaagccacccugggcggguuuggaucucucggccuggacugcgagccuagaacaggccuugauuucuccgaccuguauuaccucaccaugaauaacaaacauuggcugguccacaaggagugguuucaugauauuccccuuccuuggcacagcggggcggacacggaaacaccgcacuggaauaacaaagaggcccugguggaguucaaggacgcucaugccaagcggcagaccguugugguccucggaucccaggaaggcgcugugcacacagcccuggcgggggcccuggaagcugagauggauggagccaaaggccgccucucuagcgggcaucugaaguguagacuuaaaauggacaagcugcggcucaaaggaguuuccuacagccugugcaccgcugccuuuaccuucacaaaggugcccgccgagacgcuucacggcaccgucacaguggaaguccaauaugcuggccgcgaugggccuuguaaagugcccgcgcagauggccguugacaugcagacccugacaccugugggaagacucaucaccgcuaaucccgucauuacggagucuacagaaaacuccaagaugaugcuggagcuggauccgccuuuuggcgacagcuacaucgugauugggguuggagauaagaaaaucacccaccauuggcaccggucuggcagcaucauugggaaggccuucgaagccaccgugcgcggcgcuaaaagaauggccguccucggagacacagcgugggauuuuggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4670 - RNA, 1576 nt, Artificial Sequence
  KF383118.1 solE mRNA Design 1 opt
gggagaaagcuuaccaugagccagaaggugaucuaccuggucaugauuguucucaucgugcccgccuauuccauuucuugcaucggcgugagcaacagagaccuggucgaggggauguccggaggcaccuggguggauguugugcuugaacacgggggaugugucacagagauggcucaagacaaaccuacgguggauauugaacugguuaccaugacagugucuaauauggccgagguccggagcuacugcuaugaagcgucccucucugacauggcuagcgccucccgcuguccgacccagggcgagcccagccuggauaagcagucugacacacaguccgugugcaaaagaacccuuggggaucggggauggggcaacggcugugggaucuucggaaagggcagccuggugacaugcucuaaauuuaccuguugcaagaagaugccugggaaauccauccaacccgagaaucucgaauaccgcauuaugcugccuguccauggaagccagcacucuggcaugaucguuaacgacauugggcaugagacggaugaaaauagagccaagguggaggugacccccaacuccccucgggcugaggccacacugggaggcuucggcagccucgggcuggacugugaaccgcgcaccggacuugauuuuuccgaccuguauuaccucacaaugaauaacaaacacuggcugguccauaaggagugguuccacgauaucccccuuccuuggcacgcuggcgccgacaccgggacgccccauuggaauaacaaagaagcgcugguggaguuuaaggacgcccacgcuaagagacagacaguugugguccucggaucucaggaaggcgccgugcauaccgcucuggccggggcgcuggaggccgagauggauggagcuaaaggccgccucuucagcggccaccugaagugccggcuuaaaauggacaagcugagacucaaagggguuuccuauagccuguguacagccgcuuuuaccuucaccaaggugccugccgaaacacuucacggaacggucaccguggagguccaaucugccggcacagaugggcccugcaaagugccggcucagauggcgguugacaugcagacccugacaccugugggacggcucauuaccgccaaucccgucaucacggaauccacagagaacagcaagaugaugcuggaacuggauccucccuuuggcgacucuuacauugugaucgggguuggcgauaagaaaaucacccaucacuggcaucgcagcggauccaccauuggcaaggcuuucgaggccacagugagaggggccaaacggauggcuguccucggagacaccgccugggauuuuggcucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4671 - RNA, 1576 nt, Artificial Sequence
  KX520666.1 solE mRNA Design 1 opt
gggagaaagcuuaccaugagacagaaggugaucuaccuggucaugauucuccugaucgcccccgcuuauagcauucggugcaucggcguuuccaaccgcgacuucguggaggggaugucuggaggcaccuggguggaugucgugcuugaacacgggggauguguuacagugauggcccaagacaaaccuacggucgauauugagcuggugaccacaaccguuagcaauauggcggaagugagauccuacugcuaugaggcuucuaucagcgacauggccuccgauucucgguguccgacacagggcgaagccuaccucgacaagcagagcgauacccaguaugucugcaaacgcacacugguggacagaggguggggaaacggcuguggccuuuuugggaagggaucccuggugaccugcgcuaaauucgccuguagcaagaagaugacgggcaaaucuauccaacccgagaaucucgaguaccggauuaugcuguccguccaugggagccagcacucuggaaugaucguuaacgauaccggccaugaaacagacgagaaucgcgcuaagguggaaauuaccccuaacucccccagagccgaggcgacacucgggggauuuggcagccugggccuggauugcgagccucggaccgggcuugacuucucugaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcgccagacagugguugugcucgggucccaggaaggagcgguccauaccgcccuggcuggcgcccuggaagcugagauggacggggccaaaggaagacucagcuccggccaccugaagugucggcuuaaaauggauaagcugcgccucaaaggcgugucuuacagccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggagacucaucacagccaaucccguuauuaccgaguccaccgaaaacagcaagaugaugcuggagcuggacccgccuuuuggagauucuuacaucgugaucggcgucggggaaaagaaaauuacacaucacuggcaucgguccggcagcaccaucggaaaggcuuucgaggccacagugcgcggcgcgaaaagaauggcuguucucggggacacggccugggauuuuggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4672 - RNA, 1576 nt, Artificial Sequence
  KF383120.1 solE mRNA Design 1 opt
gggagaaagcuuaccaugagccagagagugaucuaccuggucaugauucuccugaucgcccccgcuuauuccauucggugcaucggcguuucuaaccgcgacuucguggaggggaugagcggaggcaccuggguggaugucgugcuugaacacgggggauguguuacagugauggcccaagacaagccuacggucgauauugagcuggugaccacaaccguuuccaauauggcggaagugagaucuuacugcuaugaggcuagcaucuccgacauggccucugauagccgguguccgacacagggcgaagccuaccucgacaaacaguccgauacccaguaugucugcaagcgcacacugguggacagaggguggggaaacggcuguggccuuuuugggaaaggaagccuggugaccugcgcuaaguucacguguucuaaaaagaugaccggcaaguccauccaacccgagaaucucgaguaccggauuaugcugagcguccaugggucucagcacuccggaaugaucguuaacgauauuggccaugaaacagacgagaaucgcgccaaaguggaagugaccccuaacagccccagagcugaggccacacucgggggauuuggcucucugggccuggauugcgagccucggaccgggcuugacuucuccgaucuguauuaccucacgaugaauaacaagcacuggcugguccauaaagaaugguuucacgacaucccccuuccuuggcacgcgggagccgacacaggcaccccgcauuggaauaacaaggaggcucugguggaguucaaagaugcccacgcuaagcgccagacaguugugguccucgggagccaggaaggagccgugcauaccgcgcuggccggcgcucuggaagccgagauggacggggcuaagggaagacucuuuuccggccaccugaaaugucggauuaagauggauaaacuucgccugaagggcguuucuuacagccucugcaccgccgccuucacauuuuccaaagugcccgcugagacgcugcacgggaccgucacaguggaaguccaauaugcgggaagagacggcccuuguaaggugcccgcccagauggcuguugauaugcagacccuuacaccuguggggcggcugaucaccgccaaucccauuaucacggagagcacagaaaacucucgcaugaugcucgagcuggacccgccuuucggagauuccuacaucgucauuggcgugggggacaaaaagaucacccaucacuggcauagaagcggcucuaccauuggaaaggccuuugaagcuacaguucggggcgccaaaagaauggcggugcugggggauaccgcuugggacuucggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4673 - RNA, 2359 nt, Artificial Sequence
  ZIKV (strain ZikaSPH2015) Polyprotein(93-804) mRNA Design 1 opt
gggagaaagcuuaccaugaggauaauaaaugccagaaaggaaaaaaaaagaagaggagcugauacaaguguaggaauaguaggauuauuauugacaacagcaauggcagcugaaguaacgagaagagguucagcauauuauauguacuuagacaggaaugaugcaggugaagcaauaucauucccaacaacacuaggaaugaauaaauguuauauacaaauuauggaccucggacauaugugugaugcuacgaugucauaugaaugcccuaugcuggacgagggaguugaaccagaugauguugauuguuggugcaacacaacaaguacaugggucguauauggaacaugucaucauaaaaaaggagaagcacgaaggaguagaagagcuguaacauuaccaucacauucaacgcgaaagcuacaaacgcgaucacaaacaugguuagaaagcagagaauacaccaaacaucuaauuagaguagagaauuggauuuuuagaaauccaggauuugcacuggcggccgcugcaauugcauggcuauuaggaaguucaaccagucaaaaaguaauauaccuaguaaugauauuacuaauagcgccagcuuauagcauaagaugcauaggaguuaguaaccgagauuuugucgagggaaugucaggugguacuuggguagacauagugcuagaacaugguggauguguaacaguuauggcacaggacaaaccaacaguagacauugaacucguaacaacaacuguaaguaauauggcagaaguacggucauacuguuaugaagcuaguauaucagauauggcaagcgacagcagaugcccaacucaaggggaagcauacuuagauaaacaaagugauacucaguauguauguaaacgaacauuaguagacagaggauggggaaacggauguggacuuuucgguaaagguagccuagugacaugugcaaaauuugcuuguaguaaaaaaaugacuggaaaaucaauacaacccgaaaaucuagaauauagaauaauguugucaguccacggaucacagcauucugguaugauuguaaaugauacuggacaugaaacagaugaaaauagagcaaaaguagaaauaacaccaaacaguccaagggcagaagcaacauuaggugguuuuggaucacuaggguuagauugugaaccaaggacgggauuagauuuuagcgacuuauacuauuuaaccaugaacaauaaacacugguuaguacacaaagaaugguuucacgauauaccguugccguggcaugcgggagcugauacaggcacaccacauuggaauaauaaagaagcccuaguagaauucaaagacgcacacgcgaaaagacaaacaguaguaguauuagguucgcaagaaggcgcagugcauaccgcauuggcaggugcauuggaagcagaaauggauggagcaaaaggaagguuaaguucuggacauuugaaauguagauugaaaauggauaaacuaagacuaaaaggagugagcuauucauuauguaccgcagcauuuacauucacaaaaauuccagcagaaacguuacacggaacaguuacgguagaaguacaauaugcagggacagauggccccuguaaaguaccagcucaaauggcgguugauaugcaaacccuaaccccagugggaagauuaauuacagcuaacccaguaauaacagaaaguaccgaaaauagcaaaaugaugcuugaacuagacccaccauuuggagauucauacauaguaauaggaguuggagaaaaaaagauaacacaucauuggcauaggaguggaaguacuaucggaaaagcguuugaagcgacaguuagaggagcaaaaagaauggcuguguuaggggauacagcaugggauuuuggaagcgucggaggagccuuaaauucuuuaggaaaaggaauucaucaaauauuuggggccgcauucaaaagucuauuugguggaaugucaugguuuucacaaauauuaauaggaacauuguuaauguggcuaggauuaaacacuaaaaacggaagcauaucacuaaugugucuagcuuuggguggaguacuaauauuucuauccacugcuguaucagcagacgugggguguagcguggacuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4674 - RNA, 2359 nt, Artificial Sequence
  ZIKV (isolate Z1106033) Polyprotein(93-804) mRNA Design 1 opt
gggagaaagcuuaccaugagaauaaucaaugcgaggaaagaaaagaaaagaagaggagccgacacuagcgucgguauaguagguuuauuauuaacaacugccauggccgccgaaguuacaagaagagguucagcauacuacauguauuuagauagaaaugaugcaggagaagcuauuuccuuuccuacaacucuuggaaugaauaaauguuauauccaaauuauggaucuaggacauacgugcgaugcaacaaugagcuacgaauguccaauguuagaugaaggaguagaaccagaugacguugauugcugguguaacacaacuucaacauggguaguuuauggcacaugucaucauaagaaaggagaagcaagaagaaguagacgugcaguaacauuaccaagucauucaacuagaaaacuacaaacuaggagccaaacauggcuugaaaguagagaguauacaaaacaccuuauuagaguagaaaauuggauauuuaggaauccaggauucgcguuagcagcagcugcaauagcaugguugcuaggaagcucaacaagucaaaaaguaauauauuuaguaaugauacuucuaauagcaccagcauauucaauaagauguaucggaguaucaaaccgagauuuugucgaaggaaugucuggugguacauggguagacguaguauuagagcacggaggauguguaacaguaauggcacaagauaaaccaacaguggauauagaauuggucacaacaaccguaucaaauauggcugaagucagaagcuacugcuaugaagcaucgauaagugauauggcgagugacucuagaugcccaacccaaggagaagcauacuuagauaaacaaucagacacacaauacguauguaaaagaacuuuaguagauagagguuggggcaacggauguggacucuuuggaaaaggaucgcuaguuacaugugcaaaauuugccuguucaaagaaaaugacgggaaaaucaauacagccagaaaauuuagaauauagaauaauguugaguguacauggaucccaacauucaggaaugauaguaaaugauacaggacaugaaacugacgaaaauagagcaaaaguugaaauaacaccaaauucaccacgugcagaggcgacacucggugguuucgggucauugggucuugauugugaaccaagaacaggauuagauuuuucagauuuauauuacuuaacaaugaacaauaaacacugguuaguacauaaagaaugguuucaugauauaccguuaccauggcaugcaggagcagauacaggcacaccacauuggaauaauaaagaagcauuaguugaguucaaagaugcgcacgcuaaaagacaaacaguugucguauuagguagucaagaaggagcaguacauacagcgcuagcuggagcacuagaagcugaaauggauggagcaaaaggaagacuaaguaguggucauuuaaaauguagauuaaaaauggacaaacuuagguuaaaaggaguuaguuacucauuauguacugcggcuuuuacauuuacaaaaauaccugcagaaacauuacacgguacaguuacagucgaaguacaauaugcugguacagacggaccuuguaaaguaccagcucaaauggcaguagauaugcaaacacuaacaccaguuggacgccuaauaaccgcaaauccuguuauaacagaaucuacggaaaacucaaaaaugauguuagaauuagaucccccauuuggggauucauauauaguaauugggguaggagaaaagaaaauaacacaucacuggcacagaaguggaaguacaauaggaaaagcauucgaagcaacaguaagaggagcaaaaagaauggcaguccuaggggacacugcaugggauuucggaagcguaggaggggcuuuaaauagucucgggaaaggaauccaucaaaucuuuggagcagcguuuaaaucacuauuuggaggaaugucaugguuuucacaaauauuaauagguacuuuacuaaugugguuaggacuaaaugcuaaaaacggcucaauuucauuaauguguuuagcauuaggaggaguuuugauauucuuaucaacagcaguuagcgcugacguuggauguaguguagauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4675 - RNA, 2347 nt, Artificial Sequence
  ZIKV (strain MR 766) Polyprotein(93-800) mRNA Design 1 opt
gggagaaagcuuaccaugcgaauaauaaacgcgagaaaagaacguaaacgucgaggagcagacacaagcauaggcauaauaggauuacugcuaacaaccgcaauggcagccgaaauaacaagaagaggaucagccuauuauauguaucuagauagaagugaugcagguaaagccauaucauuugcaaccacguuaggaguaaauaaaugccauguacaaauaauggaccuuggacauaugugcgaugcaacaaugucuuaugaauguccuaugcuagaugaaggaguagaaccagaugacguugauuguugguguaauacaacuuccacauggguagucuacggaacaugccaucacaaaaaaggugaagcuaggaggucaagacgagccguaacauuaccaucucauucaacaagaaaauuacaaacaagaucacaaacauggcuagaaucaagggaauauacaaaacaucuuauaaaaguagaaaauuggauuuucagaaauccugguuuugcacuaguagcaguagcaauagccuggcucuuagguagcaguaccagccaaaaaguaauauaucucgucaugauucuauuaauagcuccagccuacagcauaagauguauuggaguaucaaauagagauuuuguagaagguaugucuggaggaacauggguugauguaguuuuagaacaugggggauguguaacaguaauggcacaagauaaaccaacaguggacauugaauuagucaccacaacuguaucuaauauggcagagguacgaucauauuguuaugaagcaagcauaagcgauauggcgagugauucaagaugccccacacaaggagaagcuuauuuagauaaacaaagugauacacaguauguaugcaaaagaacccuaguggauagagguugggguaaugguugcggauuauuuggaaaaggaagucuaguaacaugugcaaaauucacuuguucaaaaaaaaugacagggaaaaguauacaaccagaaaauuuagaauauagaauaauguuaagcguacaugguucacaacauucgggaaugauaggauaugaaacagaugaagauagggccaaaguagaaguaacaccaaacaguccaagagcagaagccacacuuggugguuucggaucucucggauuagacugugaaccucgaacagggcuugacuuuucagaucuauacuauuuaacaaugaauaauaagcauuggcuaguucacaaagaaugguuucacgauauuccgcuuccauggcaugcgggagcagauacaggaacuccacauuggaauaauaaagaagcacuaguugaauucaaagaugcacaugcaaaaagacaaacagucguaguuuuaggaucacaagaaggagcaguacauacagcacuagccggagcuuuagaagcagaaauggauggugcaaaaggacgacuauuuagcggacaccuaaaaugucgucuaaaaauggauaaacuuagauuaaaaggaguaucguacucguuauguacagcagcauuuacauuuacuaaagugcccgcagaaacacuacauggaacagugacuguugaaguacaauaugcaggaacagauggcccauguaaaauuccuguucaaauggcaguugauaugcaaacauuaacuccaguuggaagacuaauaacagcaaacccuguuauaacagaaucaacugaaaauaguaaaaugauguuggaacuggacccaccauucggagauaguuacauaguaauagguguaggagauaagaaaauaacacaucauuggcacagaucagguaguaccauugguaaagcauucgaagcaacaguuagaggagcaaaaagaauggcaguucucggagauacagcaugggauuuugguagugugggagguguuuuuaacaguuuagguaaaggaauacaucaaaucuuuggugcagcuuuuaaaagccuauuuggaggaaugucaugguucucucaaauucuaauagguacacuauuaguuuggcuaggacuuaauacgaaaaaugggucuauuaguuuaacuuguuuagcacucggaggaguaaugauauucuuaaguacagcaguauccgcugacgucgguuguucaguagauuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4676 - RNA, 2359 nt, Artificial Sequence
  ZIKV (strain NatalRGN) Polyprotein(93-804) mRNA Design 1 opt
gggagaaagcuuaccaugagaauaauaaaugcaaggaaagaaaagaaaagaagaggagcagacacaagcguagguauaguaggguuauuauuaacaacugcuauggcugcugaaguaacaaggagggguagugcauauuauauguauuuagacagaaacgaugcaggggaagcaauaaguuuuccuacaacauuaggaaugaauaaauguuauauccaaauuauggacuuaggccauaugugugacgcuacaaugaguuacgaauguccaauguuagaugaagguguagaaccagacgauguggauuguugguguaacacaacaucaacauggguaguauaugguacaugucaucauaagaaaggagaagcaagaagaucaaggagagcuguaacucuaccuucacacagcacaagaaaauuacaaacuagaucacagaccugguuagaaucuagagaauauacaaaacauuuaaucagaguagaaaauuggaucuucagaaaccccggguuugcucucgcagcagcagcaauagcaugguuacuuggaaguucuacaucacaaaaaguuauuuaccuaguaaugauucuacuaauagcaccagcuuauagcauaagaugcauuggaguuaguaacagagacuuuguagaaggaaugucaggugguacuugggucgaugugguauuagaacaugggggaugcguaacuguuauggcacaagacaaaccaacaguagauaucgagcuaguaacaacaacgguaagcaacauggcagaagugagaaguuauuguuaugaagcaagcauaagugauauggcauccgauucacgauguccaacacaaggugaagcauaccuagauaaacaaucagauacacaauauguauguaaaagaacauuaguugauagggguuggggaaauggauguggacuauucggaaaagggucauuagugacgugugcaaaauuugccugcaguaagaaaaugacugggaaaagcauucaaccagaaaaucuagaauauagaauaaugcuaaguguacauggaucucaacauaguggcaugauaguaaacgauacaggacacgaaacugacgaaaacagagcuaaaguagaaaucacucccaauagcccaagagcugaagcaacacuaggaggauuuggaucauuaggacuugacugugaaccuagaacaggauuggacuuuagcgaucuauacuaucuaacaaugaauaauaaacauuggcuaguacauaaagaaugguuucaugauauuccacuuccauggcacgccggcgcagacacagggaccccucacuggaacaauaaagaagcauuaguagaguucaaagaugcucaugcaaaaagacaaacaguaguuguauuagguucgcaagaaggagccguacauacugcacuugcaggagcuuuagaagcagaaauggauggagcaaaaggacgauuaucuaguggacaucuaaaauguagacuaaaaauggacaaauuaagauuaaaaggaguaagcuauucauuauguacagcagcauuuacauucacaaaaauaccugcugaaacccuacacggcacaguaacaguagaaguucaauaugcaggaacugauggaccuugcaaaguacccgcacaaauggcaguugauaugcaaaccuuaaccccuguuggcagacuaaucacagcaaacccaguuauaacagaaucaacagaaaauagcaaaaugaugcuagaacuggauccaccuuucggugauucauauauaguaauaggaguaggggaaaagaaaauuacucaucacuggcauagaucaggaucaacaaucgguaaagcauucgaagcuacaguacgaggggcaaaaagaauggcaguacuaggagauacugcaugggauuuugguaguguagguggagcacuaaauuccuugggaaaaggaauacaccaaauauuuggagcugcauuuaaaagucuauuuggaggaaugagcugguuuagccagauucuaauuggaacauuacuuauguggcucggauuaaacacaaagaauggaaguauuucauuaauguguuuagcucucgguggcguauuaauauuuuuaaguacagcaguuagcgcagacguuggauguucaguagauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4677 - RNA, 2284 nt, Artificial Sequence
  ZIKV (strain ZikaSPH2015) Polyprotein(108-794) mRNA Design 1 opt
gggagaaagcuuaccaugacaagcguaggaauuguuggacuauugcuaacaacugcaauggcugcagagguaacucgaagaggcagcgcauacuacauguauuuggauagaaaugacgcaggggaagcaauaagcuuuccaacgacauuaggaaugaauaaauguuauauacaaauaauggauuuaggacacaugugugaugcaacuaugaguuaugagugcccaaugcuugaugaaggagucgaaccagaugauguugauuguugguguaauaccacaaguacauggguugucuacggaacaugucaccauaaaaaaggugaagcuagaagaaguagaagagcaguaacacuacccagucacucaacuagaaaacuacaaaccagaucccaaacaugguuagaaaguagggaauacacaaaacaucuaauuagaguugaaaacuggauauuuagaaauccagguuucgcuuuagcagcagcagcaauugcuugguuauuaggaaguucaacaucacagaaaguuauauaccuaguaaugauacuacuaauugcacccgcauauaguauacgauguauuggaguuagcaaucgugauuucguugaaggaaugucaggaggaacuuggguugacauaguauuagaacauggaggguguguaacgguuauggcacaagauaaaccaacgguugauauagagcuaguaacaacaacaguuagcaauauggcagaaguacgaucauauugcuaugaagcuucaauaucagauauggcaucagauucgagauguccaacacaaggggaagcauauuuagauaaacaaagugauacacaauauguauguaaacgaacacuaguagauagagguugggggaauggaugugguuuauucggaaaaggaucacuuguaacaugugcaaaguuugcauguucaaaaaaaaugacaggcaaaagcauacaaccagaaaaucuagaauacagaaucauguuaucaguacauggaucucaacauagcggaaugauaguuaaugacacaggacaugaaacagaugaaaauagagcgaaaguagagauaacaccuaauaguccaagagcagaagcaacauugggaggauucggaucucuaggacuagauugugaaccacgaacaggacuugacuuuucugauuuauacuaucuaacaaugaacaauaaacacuggcuaguacauaaagaaugguuucacgauauaccacuaccauggcacgccggagcagauaccggaacaccacauuggaauaauaaagaagcauuaguagaauuuaaagaugcccaugcuaaaagacaaacaguuguagugcuuggaagucaagaaggagcaguacauacagcauuggcuggugcauuagaagcagaaauggauggugcaaaaggaaggcuaaguucuggacaucuaaaauguaggcuaaaaauggauaaauuaagauuaaaaggaguaucauauucauuauguaccgcugccuucacuuuuacaaaaauaccagcagaaacgcugcacggaacuguaacaguugaaguacaauaugcuggaacagauggaccaugcaaaguuccugcacaaauggcuguagacaugcaaacacugacuccuguugggagacuaauuacagcaaaccccguaauaacagaaaguaccgaaaacucuaaaaugauguuagaauuagauccaccuuucggggauaguuauauaguaauaggaguaggggaaaaaaaaauaacucaucacuggcauaggagcggcaguacuauagguaaagccuuugaagcaacugucagaggugcaaaaagaauggcaguguuaggugacacagcaugggauuucggaucaguaggaggugcauuaaauaguuuaggcaaaggcauucaucaaauauuuggggccgcauucaaaagucuguucggaggaaugagcugguucagucagauauuaauaggaacacuauuaauguggcuaggucuaaacacaaaaaacgggaguauuagucucaugugucuugcauuaggaggaguauuaauauuuuuaaguacagcagucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4678 - RNA, 2284 nt, Artificial Sequence
  ZIKV (isolate Z1106033) Polyprotein(108-794) mRNA Design 1 opt
gggagaaagcuuaccaugaccucaguagguauaguagguuuacuauuaacaaccgcaauggcagcagaagugacaagaagaggaucagcauacuauauguauuuagauagaaaugaugcaggagaggcaauuucauucccaacaaccuuaggaaugaacaaauguuauauacaaauaauggauuuaggacauacaugugacgcaacaaugaguuacgaauguccaaugcuagacgaagguguagaaccagaugacguagacugcugguguaauacaacaucaacauggguuguuuacggaaccugucaucauaagaaaggugaagcaagaagaaguagacgagccguaacucuaccaucacacucaaccagaaaacuccaaacaagaagucagacauggcuugaaagccgagaauacacuaaacauuuaauaagaguugaaaauuggauuuuuagaaacccaggauucgcauuagcagcagcagcaauagcgugguuacuagguucaucaacgucacaaaaaguuauuuauuuagucaugauucuguuaauagcaccagcuuacaguauaagauguaucggaguaucaaauagggacuuuguugaaggaauguccggagguacuuggguagauguaguauuagaacauggaggauguguaacaguaauggcacaagacaaaccaaccguagauauagagcuaguaacuacuacaguauccaauauggcagaaguacguaguuauuguuaugaagccagcauaagugauauggcaucagauucaagaugcccaacacaaggugaagcauauuuagauaaacaaagugacacacaauacguauguaaaagaacauuaguagacagaggauggggaaaugguuguggauuauucgggaagggaucacuuguaacuugugccaaauucgcaugcucaaagaaaaugacagggaaaucgauacaaccagaaaauuuagaauacagaauaaugcucaguguacauggaagccaacauucaggaaugaucguuaaugauacuggucaugaaacagacgaaaacagagccaaaguugaaauaacaccuaauucaccaagagcugaagcaacauuaggaggauucggaucauuaggucuagacugugaaccaagaacaggucuagacuuuagcgauuuauauuaccuaacuaugaauaauaaacauuggcuaguucauaaagaaugguuucaugauauaccacucccuuggcaugcaggagcagacacaggaacaccacauuggaauaauaaagaagccuuaguagaauuuaaagaugcacaugcuaaaagacagacaguuguuguacucggaucucaagaaggagcaguacauacagcauuagcaggagcauuagaagcagaaauggauggugcaaaagguagauuaucuaguggucaccuuaaaugucgauuaaaaauggauaaauuaagauuaaaagggguuucauauagucuuugcacugcugcguuuacauuuacuaaaauaccagcagaaacucuacacggcacaguaacuguagaaguacaauaugcuggaacugacggccccuguaaaguaccagcgcaaauggcugucgauaugcaaacccuaacacccguaggaaggcugauaacagcaaauccuguaauaacagaaaguacggaaaauucaaaaaugauguuagaacuagauccaccauucggcgauucauacauaguaauuggaguaggagaaaagaaaauaacccaccauuggcauaggagcggaagcacaauaggaaaagcauucgaagcaacaguaagaggugcaaaaagaauggcaguacuaggagauacagcuugggacuuuggauccguugguggagcauuaaauucguuagguaaaggaauacaccaaauuuucggagcagcuuucaaaucccuauuuggaggaaugucaugguuuucccaaaucuuaauaggaacacuauuaauguggcuaggccuaaaugcuaaaaauggaucuauaucauuaaugugcuuagcacuaggcggcguucugauauuuuuaagcacugcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4679 - RNA, 2272 nt, Artificial Sequence
  ZIKV (strain MR 766) Polyprotein(108-790) mRNA Design 1 opt
gggagaaagcuuaccaugacaaguauaggaaucauuggauuacuacuaacaacugcaauggcagcagaaauaacuagacgaggaucagcauauuacauguauuuagauagauccgaugcuggcaaagcaauuucauuugcaacaacacuaggaguaaacaaaugucauguucaaauaauggaucuaggacauaugugugaugccacaaugucguaugaguguccaauguuagaugaagguguagaaccagacgauguagauugcugguguaauacgacauccacauggguaguauauggaacuugucaucacaagaaaggagaggcaagacgcuccaggagagcaguuacauuaccaagucauaguacaagaaaauuacaaacaagaagccaaacuuggcuugaaucgagagaauauacaaaacauuuaauuaaaguagaaaauuggauauuuagaaacccaggauucgcauuaguggcagucgcaauugccuggcuauuagggagcaguacaucacaaaaaguaauauaucucguaaugauacuauuaauagcuccugcauacagcauaagaugcauaggaguuucaaaccgagauuuuguagaagguaugagcggaggcacauggguagacguuguacuagaacauggaggaugugucacugugauggcacaagacaaaccaacaguagauaucgaacugguaacaacaacaguaaguaauauggcagaaguaagauccuauugcuaugaagcaucgauaucagacauggcaagugauucuagaugcccaacucaaggagaagcauauuuagauaaacaaagcgacacacaauauguaugcaagaggacucuaguagauagagguugggguaauggauguggcuuauuuggaaaaggaagucucguaacaugcgcaaaguucacauguucaaagaaaaugacuggaaaaucuauacaaccagaaaauuuagaguauagaauaaugcucagcguacaugguucacaacacaguggaaugaucggauacgaaacugacgaagaccgagcaaaaguugaaguaaccccuaauucaccaagagcagaagcaacauuaggaggguucggaagccucggauuagacugcgaaccacgaacaggauuagauuuuucagaucuauacuauuuaacaaugaacaacaaacauugguuaguucauaaagaaugguuucaugauauaccacuaccauggcaugcaggcgcugauacaggcacuccacauuggaauaacaaagaagcauuaguagaauuuaaagacgcacacgcaaaacgacaaacaguaguaguuuuaggaagccaagaaggagcgguacacacugcauuagccggugcauuagaagcagaaauggauggugcaaaaggaagacuauuuucuggucauuuaaaaugucgauuaaaaauggauaaauuaagacucaaaggaguaucuuacaguuuauguacagcagcauucacauucacaaaaguaccugcagaaacauuacauggaacgguuacaguagaagugcaauaugcuggaacagauggaccauguaaaauaccagugcaaauggcuguagauaugcagacuuuaacaccagucggaagauuaauaaccgcaaauccaguaauaacagaaaguaccgaaaauucaaaaaugauguuagaauuagauccaccauuuggcgacaguuauauuguuauaggaguaggcgauaagaaaauaacacaucacuggcauagaagcggaucuacaauaggaaaagccuuugaagcaacaguaagaggagccaaaagaauggcaguacucggugauacagcuugggauuucggaucuguuggaggaguuuucaauucauuaggcaaaggaauacaucaaauauucggagcugccuuuaaaucauuauuugguggaaugucaugguuuucucaaauucuaauagguacauuacuuguauggcuaggacuaaacacuaaaaaugguucaauaucacuaacaugucuagcuuuaggcggaguaaugaucuucuuaagcacagcuguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4680 - RNA, 2284 nt, Artificial Sequence
  ZIKV (strain NatalRGN) Polyprotein(108-794) mRNA Design 1 opt
gggagaaagcuuaccaugacaucaguaggaauagucggacuuuuguuaacgacagccauggcagcugaaguaacaagaagaggcucugcauacuauauguaucuagaccggaacgacgccggagaagcaauaucauucccaacaacauuaggcaugaauaaaugcuacauacaaauuauggaucuuggacauaugugcgaugcaacaaugucuuaugaauguccaauguuggaugaaggaguugaaccugacgauguagacugcuggugcaacacaacaucaacauggguuguauaugguaccugucaucauaaaaaaggcgaagccagaagaucaagaagggcaguaacacugccuagucauaguacuagaaaauuacaaacuagaucacaaacuugguuagaaucaagggaauacacaaaacaccuaauacgaguagaaaauuggauauuucgaaauccaggguucgcacuagcagcagcugcaauagcauggcuuuuaggaaguucaacaagccaaaaagucauauaucuaguuaugauucuacuuauagcaccugcauacucaauacgaugcauaggagucucaaauagggauuuuguagaagguaugucaggagggaccuggguagacguaguacuagaacaugguggauguguaacagucauggcacaagauaaaccaacaguagacauagaauuaguaacaacgacugucuccaauauggccgaaguuagaucauacugcuacgaagcuucuauaucagauauggcaagcgauucaagaugucccacccaaggugaagcauaucuagacaaacaaucagauacacaauacguuuguaaaagaacauuaguagacagagguuggggaaauggauguggauuauuuggaaaagguaguuuaguaacaugcgcaaaauuugcuugcagcaaaaaaaugacaggaaaauccauacaaccagaaaaccuugaguauagaauaaugcucaguguucauggaucacaacauucuggaaugauaguaaaugacacaggacacgaaacugacgagaaucgugcuaaaguagaaauaaccccaaauaguccuagagcagaagcaacauuaggcggauuuggaaguuuaggauuagauugugaaccaagaacaggcuuggauuuuagugaucuauauuacuuaacaaugaauaacaaacauugguugguccauaaagaaugguuccaugauauaccauuaccauggcacgcuggagcagauacuggaacaccgcauuggaauaauaaagaagcacuuguugaauucaaagacgcucaugcuaaacgacaaacaguaguuguacucggaagccaagaaggcgcaguccacacagcucuagcaggagcguuagaagcugaaauggauggcgcaaagggaagauuaagcucaggacaccuaaaaugcagacuuaaaauggacaaacuaagauuaaaaggaguuaguuauagccuauguacagcagcauucacauuuacuaaaauaccagcugaaacauuacauggaacuguuacaguagaaguacaauaugcaggaacagaugguccauguaaaguaccugcacaaauggcaguagauaugcaaacauuaacaccugucggaagauuaauuacagcaaauccuguaauaacggaaaguaccgaaaauucaaaaaugaugcuagaauuagacccaccuuuuggcgauagcuacauaguaauuggaguaggagaaaaaaaaauaacacaucauuggcaccgaaguggaagcacaauaggaaaagcauuugaagcaacaguuagaggagcaaaaagaauggcaguauuaggggauaccgccugggauuucgguucuguaggaggugcacuaaauagucuuggaaaaggcauacaccaaauuuuuggagcagcuuucaaaucacuguuugguggaaugaguugguuuucacaaauucuaauaggaacauuauuaaugugguuaggauuaaauacaaaaaacggaucaauaagcuuaaugugucuagccuuaggaggcguauuaauauuccuaucgacagccguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4681 - RNA, 1576 nt, Artificial Sequence
  ZIKV (strain ZikaSPH2015) Polyprotein(273-723) mRNA Design 1 opt
gggagaaagcuuaccaugagucaaaaaguaauauaucuagucaugauauuauuaauagcaccagcauauucaauaagauguauaggagucucaaacagggauuucguagaaggaaugaguggagguacguggguagauauaguuuuagaacauggaggauguguaaccguuauggcacaagacaaaccaacaguagacauagaguuagucacaacaacaguaagcaauauggcagaaguaagaucauacuguuaugaagcaaguauaagugauauggcaagugacucaagauguccaacucagggagaagcauaccuagacaaacaaucagacacacaauacguauguaaacgaacacuaguggauagaggauggggaaaugguuguggacuauuuggaaaaggaagccugguuacaugcgcuaaauuugccugcucaaaaaaaaugacaggaaaaucaauacaaccagaaaaucuagaauaucggauuauguuaagcguacauggaagccaacacucaggaaugauaguaaaugauacaggacaugaaacagaugaaaaucgagcaaaaguggaaauaaccccaaacagcccaagagcagaagcuacacuaggaggauuuggauccuuaggacuagauugugaacccagaacaggacuagacuuuucugauuuauacuaucuuacaaugaauaauaaacauugguuaguacacaaagaaugguuccaugauauaccauuaccauggcaugcaggagcagauacgggcacaccacacuggaauaauaaagaagcauuaguagaauuuaaagaugcacacgcaaaaagacaaacaguaguaguauuaggaucacaagaaggcgcaguucauacagcccuagcaggagcacuagaagcagaaauggauggagcaaaaggaaggcuuagcagcggucauuuaaaaugcagauuaaaaauggauaaauuaagacuaaaaggaguaaguuauagucuauguacagccgcauuuacauuuacaaaaauaccagccgaaacuuuacauggaacaguaacaguagagguacaauaugcaggaacggacggaccauguaaaguaccagcacaaauggcuguagacaugcaaacacuaaccccaguaggcagauuaauaacagcuaauccaguuauaacagaaaguacagaaaauucuaaaaugaugcuagaauuagacccaccuuuuggagacucauauauaguaauagguguaggagaaaaaaaaauaacacaucauuggcauagaucaggaaguacaauaggaaaagcauucgaagcaaccguaagaggagccaaaagaauggcgguacuaggugauacagcaugggauuuuggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4682 - RNA, 1576 nt, Artificial Sequence
  ZIKV (isolate Z1106033) Polyprotein(273-723) mRNA Design 1 opt
gggagaaagcuuaccaugagucaaaaaguuauauauuuaguuaugauuuuacuuauagcuccggcauacaguauaagauguauaggaguaucaaauagagauuucguagagggaaugaguggaggaacauggguagauguaguauuagaacauggagguuguguaacaguaauggcacaagacaaaccaacaguagauauagaauuaguuacaaccacaguaucaaauauggcagaaguaagaagcuauugcuaugaagcaaguauaagugacauggcaagugauagcagauguccaacacaaggagaagcauauuuagauaaacaaagugauacacaauacguuuguaaaagaacauuaguagauagagguuggggaaacggaugugguuuauuuggaaaagggucuuuaguaacuugugcgaaauuugcuugcaguaaaaaaaugacaggaaaaucaauacaaccagaaaauuuagaauauaggauaauguuaucaguacauggaucucaacauagcgguaugauaguaaaugacacaggacaugaaacagaugaaaauagagcaaaaguagaaauaacaccgaauucgcccagagcagaagcaacacugggaggauuuggaagccuaggacuagauugugaaccaagaacgggacuagauuuuucagaucuguauuaucuuacaaugaauaauaaacauuggcuagugcauaaagagugguuucaugauauaccacuaccauggcaugcaggagcagacacagguacaccacauuggaauaauaaagaagcacuaguagaauucaaagacgcacaugcaaaaagacaaacaguuguuguacuaggaagccaagaaggagcaguacauacagcauuagcaggggcauuagaagcagaaauggacggagcaaaagguagacuaucgagcggacaccuaaaauguagauuaaaaauggauaaacuacgauuaaaaggaguaaguuacaguuuaugcacagcugcauuuacauuuacaaaaauaccggcagaaacauuacauggaacgguuacaguagaaguacaauacgcuggaacagauggacccuguaaagugccugcgcaaauggcaguggacaugcaaacauugacaccaguaggaagacuaauaacagcaaauccaguaauaacagaaaguacggaaaauaguaaaaugauguuagaacuagauccuccauuuggagacucauauauaguaauaggaguaggagaaaaaaaaaucacacaccacuggcacagaucaggaucgacaauaggaaaagccuuugaagcaacaguaagaggagcaaaaagaauggcuguauuaggggacacagcaugggacuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4683 - RNA, 1564 nt, Artificial Sequence
  ZIKV (strain MR 766) Polyprotein(273-719) mRNA Design 1 opt
gggagaaagcuuaccaugucacaaaaaguaauuuaucuaguuaugauauuauuaauagcuccagcauacaguauaagauguauaggaguaucaaacagagacuuuguagaaggaaugucaggaggaacauggguugacguaguauuagaacacgguggaugcguaacaguaauggcacaggacaaaccaacaguugauauagaauuaguuacaacaacaguuucaaauauggcugaaguaagaucauauuguuaugaagcaaguauaagugacauggccagcgacaguagaugcccuacacaaggagaagcauaccuagauaaacaaagcgauacacaauacgucugcaaaagaacccuaguagacagagguuggggcaacgguuguggacuauuugguaaagguagcuugguaacaugugcaaaauuuacauguucaaagaaaaugacaggaaaaucaauacaacccgaaaaucuugaauauagaauaaugcugaguguacauggaagucaacauucaggaaugaucggauacgaaacagacgaagauagagcaaaaguagaaguaacaccaaauucaccgagagcagaagcaacacuaggaggauuuggcucacuaggauuagacugugaaccaagaacaggacuagauuucagugaucuauacuaccuaacaaugaacaacaaacacugguuaguacauaaagaaugguuucaugacauaccauuaccuuggcacgcaggagcagauacaggaacaccacauuggaauaauaaagaagcauuaguggaauuuaaagaugcucaugcaaaaagacaaacaguaguaguacuaggaagucaagaaggcgccguacacacagcucuagcaggagcauuagaagcagaaauggauggagcaaaaggaagauuauuuaguggacacuuaaaauguagauuaaaaauggauaaacuaagauuaaaagguguaucauauaguuuauguacagcagcuuucacauuuacaaaaguaccagcagaaacauuacauggaacagucacaguagaaguacaauacgcaggaacagauggaccauguaaaauaccaguacaaauggcaguagacaugcaaacacuaacuccaguaggaagguuaauaacagcaaauccaguaauaacagaaaguacagaaaauaguaaaaugauguuagaauuagaucccccauuuggagacaguuauauagugauaggcguaggagacaagaaaauaacacaucauuggcauagaucagguucaacuauaggaaaagcauuugaagcuacaguaagaggugcgaaaagaauggcaguacuaggagauacagcaugggacuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4684 - RNA, 1576 nt, Artificial Sequence
  ZIKV (strain NatalRGN) Polyprotein(273-723) mRNA Design 1 opt
gggagaaagcuuaccaugagucaaaaaguuauauauuugguaaugauauuacuaauugcuccagcauauucaauacgaugcauaggaguaucaaauagagauuucgucgaaggaaugaguggaggaacauggguagauguaguauuagaacauggaggaugcguaacaguaauggcacaagauaaaccaacaguagauauagaacuaguaacaacaaccguaucaaacauggcagaaguaagaucauauuguuaugaagcaucaauaagcgacauggcgucugauaguagaugcccaacacaaggugaggcauauuuagauaaacaaagcgauacacaauauguuugcaaaagaacauuagucgauagaggauggggaaauggauguggauuguucggaaaaggaucacuagucacaugugcaaaguuugcauguaguaaaaaaaugacaggaaaaaguauccaaccagaaaacuuagaauauagaauaaugcucaguguacaugguagucaacauaguggcaugauagugaaugauacaggucaugaaacagaugaaaaucgagcgaaaguagaaauuacacccaauucuccuagagcagaagcaacuuuaggaggauuuggaaguuuaggauuagauugcgaaccaagaacaggauuagacuucagcgaucuauacuauuuaacaaugaacaauaaacauuggcucguacauaaagaaugguuucaugacauaccucuaccuuggcacgcaggagcagauacaggaacuccacauuggaauaauaaagaagccuuaguagaauuuaaagaugcacaugcaaaaagacaaacaguagucguacuaggaagccaagaaggagcaguacauacugcauuggcaggagcauuagaagcagaaauggacggugcaaaaggaagguuaucaaguggacaucuaaaaugcagacuuaaaauggauaaauuaagauuaaaaggaguaaguuauucauuaugcacagcagcauuuacauuuacaaaaaucccagcagaaacacuacauggaacaguaacaguagaaguacaauacgcaggaacugauggaccauguaaaguaccagcacaaauggccguugauaugcaaacauuaacaccaguaggaagauuaauaacagcaaauccaguaauaacagaaaguaccgaaaacaguaaaaugauguuagaacuagauccuccauuuggagacaguuacauaguuauaggaguaggagaaaaaaaaauaacacaccauuggcacagaaguggaagcacaauagguaaagcauuugaagcaacaguaaggggagcaaaaagaauggcaguacuaggagauacagcaugggauuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4685 - RNA, 2284 nt, Artificial Sequence
  ZIKV (strain ZikaSPH2015) Polyprotein(108-794)(F398S) mRNA Design 1 opt
gggagaaagcuuaccaugacaucaguaggaauuguuggauuauuacuaacaacagcaauggcagcagaaguaacaagacgaggaagcgcauauuauauguaucuggauagaaaugaugcuggugaagcaauaaguuuuccaacaaccuuagguaugaauaaauguuacauucaaaucauggauuuaggacacaugugugaugcaacaaugucauaugaauguccuaugcuagaugaaggcguugaaccagacgauguggauuguuggugcaacacaacaaguacaugggugguauaugguacgugucaucacaagaaaggagaagcaagaagaucaaggagagcaguuacacuuccaagccauaguacaagaaaauuacaaacaagaagucaaacaugguuagaaucaagagaguacacaaaacaccuaauuagaguagaaaauuggauauucagaaauccaggguucgcacucgcagcagcagcuauagcaugguuacuaggaaguaguacaagucaaaaaguaauauaucuaguaaugauacuauugaucgcgccagcauauucuauaagauguauaggaguaagcaauagagauuuuguagaagguaugucuggagguacauggguagauauaguauuagaacacggcggaugcgucacaguaauggcccaagauaaaccaacaguagauauagaacucguaacaacaacaguuaguaauauggcagaaguaagaagcuacuguuacgaagccaguauaucagacauggcaagugauucaagauguccaacacagggagaagcauauuuagauaaacaaucugacacacaauauguuugcaaaagaaccuuaguagacagaggauggggaaacggaugcggacuaagcggaaaagguagcuuaguaacaugugcaaaauucgcaugcucaaagaaaaugacuggaaaaagcauacaaccagaaaacuuagaauauagaauuauguuaaguguacauggaucacaacacaguggaaugauaguaaacgacacuggacaugaaaccgaugaaaaucgagcaaaaguagaaauaacaccuaauagcccgagagcggaagccacacuaggaggauucggaaguuuaggacuagacugugaaccaagaacaggauuagacuuuagugaucuauauuauuuaaccaugaacaauaaacauugguuaguucauaaagaaugguuccaugacauaccauuaccauggcacgcaggagcagauaccgguacgccgcauuggaauaacaaagaagcucuaguagaauuuaaagaugcacaugcaaaacgacaaacuguagugguacuaggaucacaagaaggagcaguucauacagcuuuagcgggggcgcucgaagcagagauggacggugcaaaagguagauuaaguucaggacaccuaaaauguagacuaaaaauggauaaacuaagauuaaaaggaguaucguauucuuuauguacagcugcguuuaccuuuacaaaaauuccagcagaaacauuacauggaaccgucacaguugaagugcaauacgcaggaacugaugguccaugcaaagucccugcacagauggcaguagauaugcaaacgcuaacaccgguaggacgauugaucacugcgaauccugugauaacugaaagcaccgaaaauucaaaaaugaugcuggaauuagauccuccauuuggagacaguuacauaguaauaggaguaggagaaaagaaaauaacacaucauuggcacagaucaggaaguacaauaggcaaagcauuugaagcuacagugaggggagcaaaacgaauggcaguauuaggugauacagcaugggacuuuggcaguguaggaggggcacuaaauucuuugggaaaagguauacaucaaaucuuuggagcagcauuuaaaaguuuauuuggaggaaugagcugguuuucacaaauuuugauaggcacuuuauuaaugugguuaggacuaaauacuaaaaauggaucaauaucauuaauguguuuagcuuuaggaggcguauuaauauuuuuauccacagcagugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4686 - RNA, 2284 nt, Artificial Sequence
  ZIKV (isolate Z1106033) Polyprotein(108-794)(F398S) mRNA Design 1 opt
gggagaaagcuuaccaugacauccguaggaauuguaggauuauuacuaacaaccgcaauggcagcagaaguaacgcgacgaggaagugcauauuacauguacuuagauagaaaugacgcuggugaagcaauaaguuuuccuacaacucuugggaugaacaaauguuacauccaaauaauggaucuuggccauacaugugaugcaacaaugucauaugaauguccaauguuagaugaaggagucgaacccgacgaugucgauuguuggugcaauaccacaucaacauggguuguauauggaacaugccaucauaagaaaggagaagcgcggagaaguagacgagcaguaacauuaccaucacauucgacacgaaaauuacaaacaagaagucaaacaugguuagaaagcagagaauacacaaaacauuuaauaagaguagaaaacuggauauuuagaaauccaggguuugcauuagcagcagcagcaauagcauggcuucuaggauccaguaccucacaaaaaguaauauacuuaguaaugauauuauugauugcaccagcuuauucuauaagauguauuggaguuagcaauagagauuuuguagaagggaugaguggaggaacauggguagauguaguuuuagaacacggagguuguguaacaguaauggcacaagauaaaccaacaguagauauagagcuaguaacaacuacugugagcaauauggcagaaguucgaucauacuguuacgaagcaucaauaagugacauggcaucggauagcagauguccaacacaaggugaagcauaucuagauaaacaaucagauacucaauauguauguaaacgaacuuuaguagauagaggauggggaaauggaugcgguuuaagcggaaaaggcucauuaguuacaugugcuaaauucgcuuguaguaagaaaaugacaggaaaaucaauacaacccgaaaaucuagaauaucgaauaauguuauccguacauggaagccaacauucagguaugauaguaaaugacacaggacaugaaacagacgaaaauagagcuaaaguagaaauaacuccuaauucaccaagagcagaagcuacacuaggagguuucgguagccuaggguuagauugugaaccaagaacaggauuagacuuuucagacuuauauuaccuaacaaugaauaauaaacauugguuaguucacaaagaaugguuucacgauauaccauugccuuggcaugcaggagcagauacuggaacaccacacuggaauaauaaagaagcauuaguagaauuuaaagaugcacacgcaaaaagacagacaguugucguauuagggucacaagaaggagcuguacauacagcauuagccggagccuuagaagcagaaauggacggagcaaaaggaagacuaaguagcggacaucuuaaauguagacuaaaaauggacaaacuacgacugaaaggaguaucauauucauuauguacagcagcuuuuacauucacaaaaauaccagcugaaacccuacauggaacaguaacagucgaaguucaauacgcaggaacggacggaccauguaaaguaccagcucaaauggcaguagacaugcagacuuuaacaccaguagggaggcuaauuacagcaaacccuguuauaacagaaucaacggaaaacucaaaaaugauguuggaauuagauccaccuuuuggagacucauacauaguaauaggaguaggagaaaagaaaauaacacaucacuggcaucgaaguggaucaacuauugguaaagcauuugaagcaaccguaagaggagcuaaaagaauggcuguuuuaggugauacagcgugggauuuuggcucagugggaggugcauuaaacucuuuaggcaaagggauacaccaaauauuuggugccgcauuuaaaucauuauucggaggcaugucaugguucagccaaauauuaauaggaacauuauuaaugugguuaggucuaaacgcaaagaacggaaguauuucucuaauguguuuagcauuaggaggaguucuaauauuucuaucaaccgcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4687 - RNA, 2272 nt, Artificial Sequence
  ZIKV (strain MR 766) Polyprotein(108-790)(F398S) mRNA Design 1 opt
gggagaaagcuuaccaugacaucaauuggaauaaucggcuuauugcuaacuacagcaauggcagcugaaauuacaagaagaggaucagcuuauuauauguaucuagacagaucagaugcugguaaagcaauuucauucgcaacaacacuaggcguaaauaaaugucacguacaaauaauggauuuaggccauaugugcgaugcaacaaugucguaugaauguccaauguuagacgaaggaguggaacccgaugauguagacuguuggugcaacacaacuucaacauggguaguauacggaacaugccaucacaaaaaaggagaagcaagaagaucaagacgagcaguuacucuaccaagccauaguacaaggaaacuacaaaccagaucacaaacauggcuagaaucacgugaauacacaaagcauuuaauaaaaguagaaaacuggauauuuagaaauccaggguucgcauuaguggcaguagcaauagcauggcuauuaggaucaucaacaucacaaaaaguaauauauuuaguaaugauauuauuaauagcgccagcauauaguauacgauguauaggaguaucaaacagagauuuuguggaaggaaugucaggagguacauggguggacguaguucuagaacacggaggcuguguaacaguaauggcacaagacaaaccuaccguagauauagaacuagugaccacaacaguaucaaacauggcggaaguaaggucuuauugcuaugaagccaguauaucagauauggcaucugauagcagaugcccaacacaaggagaagcauaucuugauaaacaaucugauacacaauauguauguaaaagaaccuuaguagaucgaggauggggaaaugguuguggacuaucagguaaagguucauuagucacaugugcuaaauucacuuguaguaaaaaaaugacaggaaaaucuauacaaccagaaaaucuugaauauaggauaauguuaaguguccacggaagucaacauucagggaugauagguuaugaaacagaugaagacagggcaaaaguagaaguaacaccaaacagcccaagagcggaagcaacauuaggaggauucggaagccucggacuagacugugaaccacggacgggauuagacuucagcgaucuuuauuauuuaacaaugaauaauaaacacuggcuaguucauaaagaaugguuccaugauaucccucuaccauggcaugcaggagcagauacaggaacaccccacuggaauaauaaagaagccuuaguagaauuuaaagaugcccacgccaaaagacaaacgguaguuguauuaggaucacaagaaggagcaguacauacggcguuagcuggcgcccuagaagcagaaauggauggugcgaaaggaagacuauuuucaggccaucucaaaugcagauugaaaauggauaaacuuagacuaaaaggaguaucauauucauuauguacagcagcauuuacauuuaccaaaguaccagcagaaacauuacauggaacaguuacaguagaaguucaauaugcagguacagauggaccuuguaagauaccaguacaaauggcgguagauaugcaaacacucacuccaguugguagauuaauuacugcaaacccaguaauaacagaaucgacggaaaauucuaaaaugauguuagaauuagacccaccauuuggagauaguuauauagugauaggugugggagauaaaaaaauaacacaucauuggcaucgaucagggucaacuauagguaaagcauucgaagcaacagugagaggggcaaaaaggauggcaguacuaggagauacugcaugggauuuuggcagugucggugggguuuuuaauagccuagguaaaggaauacaccaaauauuuggcgcagcguucaaaucauuauuuggcggaaugucaugguuuucucaaauacuuauaggaaccuuacuaguaugguuggguuuaaacaccaaaaauggaaguauuucacuaacauguuuagcccugggaggaguaaugauauuucuaagcacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4688 - RNA, 2284 nt, Artificial Sequence
  ZIKV (strain NatalRGN) Polyprotein(108-794)(F398S) mRNA Design 1 opt
gggagaaagcuuaccaugacaucaguaggaauaguaggacuacuauuaacaacagcaauggcagcugagguaacaagaagaggaagcgcuuauuauauguauuuagauagaaaugaugcaggagaagcuaucagcuucccaacaacacuaggaaugaacaaauguuauauacaaauaauggauuuaggccacaugugcgaugcaacaaugagcuaugaauguccaauguuagaugaaggaguagaaccugaugauguugauuguuggugcaacaccacaaguacauggguaguuuauggaacaugccaucacaagaaaggugaagcacgaagaucaagacgagcaguaacacugccaucucauucaacacgaaaauuacagacaagaagucagacauggcuugaaaguagagaauauacgaaacaccuaauacgcguagaaaauuggauauuuagaaacccuggauuugccuuggcggcagcagcaauagcuugguuauuagguucuaguacaucacaaaaaguaauauaucuaguaaugauacuacuaauagcaccagcauacucaauaagaugcauaggaguaagcaacagagauuucguagaaggaaugaguggaggaaccuggguagauguaguccuagagcacggaggauguguaacaguaauggcacaagacaaaccaacuguagauauagaacuuguaacaacaacgguaucaaacauggcagaaguacgaaguuacugcuacgaagcaucaauaucugacauggcuucagauucaagaugcccaacacaaggagaagccuaucuagauaaacaaucagacacacaauacguuugcaaacgaacauuaguagaccgagguuggggaaacggaugugggcuaucagggaaagguucacuuguaacaugugcaaaauuugcaugcucaaagaaaaugaccgguaaaaguauucaaccagaaaaucuagaauacagaauuaugcuaucaguacacggaucacaacauagugguaugauaguaaaugacacuggacaugagacugaugaaaauagagcaaaaguagaaauaacaccaaauaguccaagagcagaagcaacauuaggaggauuugguaguuuaggacucgacugugaaccacggacugggcuggauuuuagugacuuauauuacuuaaccaugaauaauaaacacugguuaguacacaaagaaugguuccaugauauaccuuugccauggcaugcuggugcagauacaggaacuccccauuggaauaauaaagaagcacuuguagaauuuaaagaugcacacgcaaaacgacaaacaguaguuguacuagguucccaagaaggagcaguacauacagcacuugcaggagcucuagaagcugaaauggauggagcuaaaggacgauuaaguaguggacaccuaaaauguagacuuaaaauggacaaauuaagguuaaaaggaguaaguuauucauuauguacagcagcauucaccuucacuaaaauaccugcggaaacacuccacgguacaguaacuguagaaguacaauaugcaggaacagauggaccauguaaaguaccagcacaaauggcuguggauaugcaaacacuaacucccguaggaagacuaauaacugcaaacccaguaaucaccgagaguacagaaaacucuaaaaugauguuagaauuagauccaccauuuggagauucauacauuguaauuggaguaggugaaaagaaaauaacucaccauuggcauagaucuggaaguacaauaggaaaagccuucgaagcaacaguaagaggugcuaaacggauggcaguauuaggagauacggcaugggauuuugguucuguagguggagcacuaaacucccuagggaaagggauucaccaaauuuuuggagcagcauuuaaaucauuauuuggaggcaugagcugguuuucacagauacuaauagguacauuacuuaugugguuggguuuaaacacuaaaaacgguucaauuucauuaaugugcuuagcacuaggugguguguuaauauuucuaaguacagcgguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4689 - RNA, 2284 nt, Artificial Sequence
  ZIKV (strain ZikaSPH2015) Polyprotein(108-794)(N444Q) mRNA Design 1 opt
gggagaaagcuuaccaugaccagcguaggaauuguagggcucuuauuaacaacagcuauggcagcagaagugacaagaagggguagugccuauuacauguacuuagauagaaaugacgcaggugaagcaauuucauuuccaacaacauuaggaaugaauaaauguuacauacaaauaauggaccuaggacauaugugugacgcaacaaugaguuaugaaugucccauguuagacgaggggguugaaccagaugauguagauugcugguguaauacaacgaguacguggguaguauauggaacgugucaucauaaaaaaggagaagcucguagaaguaggagagcaguaacuuuaccaagucacucaacaagaaaauuacaaacaagaagccaaacaugguuagaaucaagagaauauacaaaacaucucauaagaguagaaaauuggauauuuagaaauccaggauuugcauuagcagcugcugcaauugccugguuacucggaaguuccaccucacaaaaaguaauauaccucguaaugaucuuguuaauagcaccagcuuauucgauaagauguaucggaguuaguaauagagauuuuguugaaggcaugagcggagggacauggguagauauaguacuugaacauggcggauguguuacaguaauggcacaagauaaaccaacgguagauauugaauuaguaacaacaacagucaguaacauggcugaaguaagaucauauugcuaugaagcuaguauaucugauauggcuagugauaguagauguccaacucaaggagaagccuauuuagauaaacaaagugacacucaauauguuuguaaaagaacauuaguagacagaggauggggaaaugguuguggauuauucggaaaaggaagcuugguaacaugugcaaaauucgcauguaguaaaaaaaugacaggaaaaucuauucaaccagaaaacuuagaauauaggauaauguuaucagugcacggcucacaacauaguggaaugauaguacaagacacagggcaugaaacagaugaaaauagagcaaaaguagaaauaacuccaaacaguccuagagcugaagcaacucuagguggauuuggaaguuuaggcuuagauugugaaccaaggacaggauuagauuuuagugauuuauauuaccuaacaaugaauaauaaacauuggcuuguacauaaagaaugguuccaugauauuccacuaccauggcaugcaggagcagacacugguacuccacauuggaauaacaaagaagcauuaguugaauuuaaagaugcccaugcuaaaagacaaacaguaguaguauuaggaagucaagaaggagcuguucacacugcacuugcaggagcacuagaagcagaaauggauggagcaaaaggacgguuaagcaguggacauuuaaaaugcagacuaaaaauggauaaacuucgauuaaaagggguaucauauaguuuauguacugcagcuuuuacguuuacaaaaauaccagcggaaacacuacauggaacaguuacaguugaaguacaguaugcaggcacugauggaccuuguaagguaccagcgcaaauggcaguagacaugcaaacacuaacuccagugggacgacuaauaacagcaaauccaguaauaacagaaagcacagaaaauaguaaaaugaugcuagaacuagacccaccauuuggagacucauacauagucauaggcguaggagaaaaaaaaauaacccaucauuggcacagaaguggaucaacuauaggaaaagcauuugaagcaacaguucguggagcaaagagaauggcaguauugggagacaccgcaugggauuucgguaguguuggaggugcacuuaauucauugggaaaaggaauacaucaaauuuuuggagcagcuuucaaaaguuuauucggcgggaugucaugguucagucaaauauuaauagguacuuuacuaaugugguuaggauuaaauacaaaaaaugguagcauuucacuuaugugucuagcauuaggagguguuuugauauuucuaucaacagcugugucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4690 - RNA, 2284 nt, Artificial Sequence
  ZIKV (isolate Z1106033) Polyprotein(108-794)(N444Q) mRNA Design 1 opt
gggagaaagcuuaccaugacaucagucggaauagucggacuucuauuaacuacugcaauggcagcagaagucacaagaagaggaucagcuuauuacauguacuuagauaggaaugaugcuggagaagccauuagcuuucccaccacuuuaggcaugaauaaauguuacauacaaauaauggauuuaggacauacaugugaugcaacaaugucauacgaaugucccauguuagaugaagguguagaaccagaugauguugauuguuggugcaauacaacaucaacauggguaguauacggaacaugccaucauaagaaaggagaagcaaggcgaucaagacgagcaguuacauugccuagucauaguaccagaaaauuacaaacaagaucucaaacaugguuagaaaguagagaauacacaaaacaucuaauaagaguugaaaacuggauauucagaaauccaggauuugcacuagcagcagcagccauagcauggcuauuaggaucaagcacaagucaaaaaguuauauacuuagugaugauauuauuaauagcaccagcuuacucuauaagauguaucggagucuccaacagagauuuuguagaaggaaugucaggaggaacauggguugauguaguauuagaacaugguggauguguaacaguaauggcacaagauaaaccaaccguagauauagaauuagucacaacaacuguaucaaauauggccgaaguaagaaguuacuguuaugaagcaucaauuucugacauggcuucagauagccgcugccccacacaaggcgaggcauauuuagacaaacaaagcgauacacaauauguauguaaaagaacucuaguugauagaggaugggguaauggauguggacuauucgguaaagguucauuaguaacaugugcaaaauuugcuuguagcaagaaaaugacagggaaaucaauccaaccagaaaaucuagaauauagaauaauguuaucagugcacggaagucagcacucagguaugauaguucaagauacaggacaugaaacagacgaaaauagagcaaaaguggaaaucacgccaaauucaccaagagcugaagcuacccuagguggcuuuggaucauuaggcuuagauugcgaaccaaggacaggauuagauuuuucagaucucuacuauuuaacaaugaauaauaaacacuggcuaguccacaaagaaugguuccaugauaucccauugccuuggcaugcuggagcagauacagguacaccacauuggaauaacaaagaagcacucguagaguucaaagaugcacaugcaaaaagacaaacaguaguaguacuaggaucccaagaaggugcaguucacacugcacuggcaggagccuuagaagcagaaauggauggagcaaaaggaagauuaucaaguggacaccuaaaauguagauuaaaaauggauaaacuaagauuaaaaggaguauccuauucccucugcaccgcagccuucacuuuuacuaaaauaccagcagaaacauugcauggaacaguuaccguagaaguacaauacgcaggaacugauggacccuguaaaguacccgcacaaauggcaguagauaugcaaacacucacaccaguaggaagauuaauaacagcaaauccaguaauaaccgaaucaacagaaaacagcaaaaugaugcuugaauuagauccaccuuuuggagauucauauauaguaauugguguaggcgaaaagaaaaucacacaucauuggcauagaaguggaucaaccauaggaaaagcauuugaagcaacaguaagaggggcaaaacgaauggcgguccuaggagacacggcaugggauuuuggaucaguaggaggagcauuaaauucacuaggaaaaggcauucaucaaauauucggagcugcauucaaaaguuuauucggaggaaugucaugguuuagucaaauacuuauaggcacauuauuaauguggcuaggauuaaacgccaaaaaugggucaauaucacucauguguuuagcuuuagguggaguauuaauauuuuuauccacagcaguaucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4691 - RNA, 2284 nt, Artificial Sequence
  ZIKV (strain NatalRGN) Polyprotein(108-794)(N444Q) mRNA Design 1 opt
gggagaaagcuuaccaugacaagcgugggaauaguuggacuacuauuaacaacagcaauggcagcagaagugacucgucggggaagugcauauuauauguauuuagauagaaaugacgcaggagaagcaauuaguuuuccaacaacauuaggaaugaauaaauguuacauacaaauuauggaucuaggacacaugugugaugcaacaaugucauaugaauguccgaugcuagacgaaggaguagagccagaugauguugacugcuggugcaauacaacaagcacauggguagucuacggaacuugccaucauaagaaaggagaggcacgaagaagccggagagcuguaacuuuaccuagccauucuacucgaaaauuacaaacaagaucacaaacuuggcuagaaagucgagaauauacaaaacauuuaauaagaguagaaaacuggauauuccguaauccuggguuugcucuugcagcagcagcaauagcguggcuacuaggaaguagcacaagucaaaaaguaauauacuuagugaugauauuauuaauagcuccagcauauucaauuagauguaucggugugaguaauagagauuucguagaaggaaugaguggagggacuuggguagauguaguuuuagaacacggaggaugugucacagugauggcucaagacaaaccaacuguagacauagaacuuguaacuaccacaguaucaaacauggcagaaguuagaaguuauuguuaugaagcaucuauaucagauauggcaucagauucacgauguccaacacaaggcgaagcguaucuagauaaacaaucggauacucaauauguauguaaaagaacuuuaguagauagaggauggggaaauggauguggccuauucggaaaaggaucauuagugacaugcgcuaaauuugccuguagcaagaaaaugaccgguaaaaguauucaaccagaaaauuuagaauauagaauaauguuaucaguucacggaucacaacauaguggaaugauaguucaagauacaggccacgaaacugacgaaaauagagcaaaaguagaaauaacaccaaauucuccaagagcagaagcaacacuaggcggauuuggaucauuaggauuggauugugaaccucgaacaggauuagacuuuagugauuuguauuauuuaacaaugaacaacaaacauugguuaguacacaaagaaugguuucacgauauaccacuaccauggcaugcaggagcagauacgggaacaccccauuggaauaauaaagaagcgcuuguagaauuuaaagaugcucaugcaaaaaggcaaacaguaguaguauuaggaagucaagaaggagcaguacauacagcucuagcuggagcccuggaagcugaaauggauggggcuaaaggaagacuuagcucaggacaucuaaagugccgauuaaagauggacaaauuaagauuaaaaggcguaaguuauucuuuauguacagcagcauuuacauuuacaaaaauaccagcagaaacgcugcaugguacuguaacaguagaaguacaauaugcaggaacugacggaccauguaaaguaccagcacaaauggcgguugauaugcaaacauuaacaccuguaggaagacucauuacagcaaacccaguuauaacagaaucuacagaaaauuccaagaugaugcuggaguuagaucccccauuuggugauaguuauauaguuaucgguguaggugagaagaaaauaacacaucacuggcaccgaaguggaucaacaauagguaaagcauucgaagcaacaguaagaggagcaaaaaggauggcaguauuaggugacacagccugggauuuuggaucuguaggaggagcacuuaauucauuaggaaaaggcauucaccaaauauuuggagcagcauuuaaaucauuauucgguggaaugucaugguuuucacaaauuuugauagguacacuacuaauguggcuaggacuaaacaccaaaaaugggucaauaagucuaaugugcuuagcguuaggaggaguacuaauauuccuaaguacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4692 - RNA, 2284 nt, Artificial Sequence
  ZIKV (strain ZikaSPH2015) Polyprotein(108-694)-Cterm-JAEV1-E(400-500) mRNA Design 1 opt
gggagaaagcuuaccaugacauccguagguauaguagguuuacuauuaacuacugcgauggccgcagaagucacaagaagagguucagcuuacuauauguaucuagaucguaaugacgcaggagaagcaauaucauucccuacaacauuagguaugaauaaauguuauauccaaauaauggauuuagggcauaugugugaugcaacaaugaguuaugaaugcccaaugcuagaugaaggaguagaaccagacgacguugacugcugguguaauacaacaagcacauggguaguauacggaacaugucaccauaaaaaaggagaagcucgaaggucacgacgagcgguuacauugccaucucauaguacaagaaaacuacagacaagaucacagacauggcuagaaaguagagaauacacaaaacaucuaauucgaguagaaaacuggauauuuagaaauccaggcuuugcacucgcagcagcugcaauagcauggcucuugggaaguucaacaucacagaaaguaauauaccuaguaaugauauuacuuauagcaccagccuauaguauuagguguauaggaguaucuaauagagauuuuguagaaggaaugagcggagggacauggguagauauaguacuagaacauggaggauguguaacuguaauggcacaagauaaaccaacaguugacauagaacuaguaacaacaacaguaucaaauauggcagaaguaagaaguuauuguuaugaagcgaguauaagugauauggcaucagauucaagaugcccuacacaaggagaagcauaccuagacaaacaaucggauacacaauauguauguaaaaggacauuaguugauagagguugggggaacggauguggguuauucggaaaaggaaguuuaguaaccugcgccaaauuugcauguaguaagaaaaugacagggaaaaguauccaaccugaaaaucuggaauacagaauuauguuaagugugcauggaagucaacacaguggaaugauaguaaaugauacgggacacgaaacagaugaaaauagggcaaaagucgaaauuacaccaaacagccccagagcagaagcaaccuuaggaggauuuggaucauuaggauuagauugcgaaccaagaaccggauuagacuuuagcgaucuguacuauuugacaaugaauaauaaacauuggcuaguacauaaagaaugguuccaugauauaccauuaccauggcacgcaggugcugauacuggcacaccacauuggaacaacaaagaagcacucguugaauucaaagacgcccaugcaaaacgacaaacaguagucguuuuaggaucacaagaaggagccguacacacugcauuagcaggagcauuagaagcagaaauggauggcgccaaagggagacuaucgaguggucaucuuaagugcagacuaaaaauggauaaauuaagguuaaaaggaguaaguuacucucuaugcacagcagcauuuacauuuacuaaaauaccugcugagacauuacauggaacuguaacuguagaaguacaauacgcagggacugauggaccauguaaagugccagcacaaauggcaguagauaugcaaacauuaacaccaguaggacgauuaauaacggcaaauccaguaaucacugaaucaacugaaaauaguaaaaugauguuagaguuagauccaccauucggcgauaguuauauaguaauaggagugggcgaaaaaaaaaucacucaucauuggcacagaagcggcaguacauuaggaaaagcauucagcacaacauuaaaaggagcucaaagauuagcagcacuaggugauacagcaugggauuucggaucaauuggaggaguauucaauucaauagggagagcagugcaucaaguauucgguggcgcauuuagaacucuguucggaggaaugaguuggauaacacaaggacuaaugggugccuuauuauuauggaugggaguaaaugcacgagaccgaucaauagcacuagcauuucuagcaacuggagguguauuaguauuucuggcaacuaacguccacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4693 - RNA, 2284 nt, Artificial Sequence
  ZIKV (isolate Z1106033) Polyprotein(108-694)-Cterm-JAEV1-E(400-500) mRNA Design 1 opt
gggagaaagcuuaccaugaccaguguaggaauaguagguuuacuccuuaccacagcaauggcggcagaaguaacacggagaggaucugcauauuacauguaccuugacagaaaugacgcgggagaagcaauaaguuucccaacaacacuagggaugaauaaaugcuacauucaaauuauggaucuaggacauacaugugaugcgacgaugagcuaugaaugcccaauguuagaugaagguguagaaccagaugauguagacugcugguguaauacuacaucgaccuggguuguauauggaacaugucaucauaagaaaggagaagcacgaagaagcaggagagcaguaacauuacccagucauucaacaagaaaauuacaaaccagaucacaaacauggcuagaaucaagagaauauacaaaacauuuaauaagaguagaaaacuggauuuuuagaaauccaggauuugcauuagcugcugcagcuauagcauggcuucuuggcaguucaaccagccaaaaaguuauauauuuggucaugauuuugcuaauagcaccagcauauaguauacgauguauaggaguaucaaauagagacuuuguugaaggaaugucuggaggaacaugggucgauguaguacuagaacauggaggauguguaacaguaauggcacaagauaaaccaacaguugauauagaauuaguaacaacaacaguaucgaauauggccgaaguaagaaguuauuguuaugaagcaucaauauccgauauggcaucagauagcagauguccaacucaaggagaagcauaccuagauaaacaaucagauacucaauauguuuguaaaagaacauuaguugacagaggcugggguaauggaugcgguuuauucggcaaaggcucauuaguaacaugugcaaaguuugcauguucaaagaaaaugacaggaaaaucaauacaaccagaaaauuuagaauaucgaauaauguuaaguguacauggaucccagcacucaggaaugauaguuaaugauacaggucacgaaaccgaugagaauagagcaaaaguagagauaacuccaaauaguccaagagcagaagcuacauuaggaggauuugguagcuuagguuuagauugugaaccacgaacaggauuagauuucagugaucuauauuaucuaacuaugaauaauaaacacugguuaguacauaaagaaugguuucaugauaucccacuuccauggcaugcaggagcagauacaggaacaccccauuggaauaauaaagaagcauuggucgaauuuaaagaugcacaugcaaaaaggcaaacaguuguaguguuaggaucacaagaaggagcuguacacacagcacuugcuggugcacuugaggcagaaauggauggagcaaaaggaagacugagcagcgggcauuuaaaauguagauugaaaauggauaaauuacgccugaaaggaguaaguuauagucuauguaccgcagcauuuacauuuacaaaaauaccagcugaaacgcuacauggaacggucacaguagaaguacaauaugcagguacagauggaccauguaaaguaccagcacaaauggcaguagacaugcaaacacuaacaccaguuggaagauugaucacugcaaauccaguuauaacagaaucaacugaaaauucgaaaaugauguuagaguuagacccuccguuuggugacucauauauaguaaucggaguaggagaaaagaaaauaacacaucacuggcauagaucaggaaguacacuaggaaaggcuuuuagcacaacauuaaaaggugcucaaagauuagcagcauuaggcgauacagcuugggacuuuggaucaauaggcggaguauuuaacaguauaggaagggccguacaucaaguauuuggaggagcauuuagaacacucuuuggaggaaugagcuggauaacacaagguuuaaugggagcauuauuacuuuggaugggaguaaaugcacgagaucgaaguauagcauuagcauuucuagcaacugguggaguccuaguauuucuagcaacaaacguacaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4694 - RNA, 2272 nt, Artificial Sequence
  ZIKV (strain MR 766) Polyprotein(108-690)-Cterm-JAEV1-E(400-500) mRNA Design 1 opt
gggagaaagcuuaccaugacaucaauagguaucauaggccuauuacuaacuacagcaauggcagcagaaauaacuagaagagguucagcauauuacauguaucuagauagaagugaugcagguaaagcaauaaguuuugcaacaacauuaggaguaaauaaaugccauguacaaauaauggaucuaggucauaugugugacgcaacaaugaguuaugaaugcccuaugcuagacgaaggaguugaaccugaugacguagauuguuggugcaacacaacaaguacuugggugguauauggaacuugucaucacaagaaaggagaagcaagacgaucaagacgagccguaacucuaccaucucacucaacaagaaaacuacaaacacgcucacagacaugguuagaaucaagagaauacacuaaacauuuaauuaaaguugaaaacuggauuuuucgaaauccagguuuugcauuaguagcuguagccauagcauggcuacuaggaaguucuacaucucaaaaaguaauauaucuuguaaugauacuacuaauagcuccagcauauucaauuagauguauaggaguaagcaauagagauuucguagaaggaaugaguggaggaacauggguagauguaguauuagaacauggugguuguguaacaguaauggcacaagacaaaccaacagucgacauagaauuaguuacaacuacgguaaguaacauggcagaaguuaggaguuauuguuaugaggcaucaauaagcgauauggcgucagauucaagaugcccaacacaaggagaagcauauuuagacaaacaaagugauacgcaauacguauguaaaagaacucuaguagacagggguuggggaaauggaugcgguuuauuuggaaaaggcagucuaguaacaugcgcaaaauuuacauguucaaagaaaaugacaggaaaaucuauucaaccugagaauuuagaauaucgaauaauguuaucuguacauggaucucaacauucaggaaugauaggguaugaaacugacgaagauagagcaaaaguagaaguaacgcccaauucuccaagagcagaagcaaccuuaggcggauuuggaaguuuaggacuagauugugaaccaagaacaggucuagacuuuucagaucucuacuaucuaacaaugaauaauaaacacuggcuugugcauaaggaaugguuucaugauaucccauuaccauggcaugcaggagcagacacaggaacaccucauuggaauaauaaagaggccuuaguagaauuuaaagaugcacaugcgaaaagacaaacaguaguaguuuuaggaagucaagagggagcaguucauacagcauuagccggagcacuugaagcggaaauggauggagccaaaggacgucuauuuaguggacacuuaaaaugcagauuaaaaauggauaaacuuagacuaaaaggugucucauacucucuaugcacagccgcguuuacauuuaccaagguaccagccgaaacacuucacggaaccguaacuguagaaguacaauaugcaggaacagauggaccauguaaaauuccuguacaaauggcaguagauaugcaaacauuaacacccguagguagauuaauaacagcaaaucccguaauuacagaaucaacagaaaauaguaaaaugauguuagaacuagauccuccauuuggagauucauauauaguaauaggaguaggugacaagaaaauaacacaucauuggcacagaagugguagcacauuaggaaaagcauuuaguacaacacucaaaggagcacaaagauuagcagcacuaggagauacagcaugggacuuuggaagcauuggagguguauuuaauaguaucgguagagcaguucaucaaguguuuggaggagcauucagaacacuauuuggagguaugucuuggauuacacaagguuuaaugggugcauuauuauuguggaugggaguaaaugcacgagaucguucaauagcauuggccuuuuuagcaaccgguggaguccugguguuuuuagcaacuaauguccaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4695 - RNA, 2284 nt, Artificial Sequence
  ZIKV (strain NatalRGN) Polyprotein(108-694)-Cterm-JAEV1-E(400-500) mRNA Design 1 opt
gggagaaagcuuaccaugacaucuguagguauaguaggacuccuuuuaacaacagcaauggcagcagaaguaacgagaagagguagcgcauauuauauguauuuagauagaaacgacgccggagaagcaauuagcuuuccuacaacauuaggcaugaauaaauguuauauacaaauaauggaccuuggacauaugugugaugcaacuaugagcuaugaaugcccuaugcuagaugagggaguagaaccagaugacguagauuguugguguaacacaacaagcacaugggucguuuauggcacaugccaucauaaaaaaggagaggcaagacguagucgaagagcaguaacacuaccaucgcauucaacacgaaaauuacaaacuagaagccaaacauggcuagaaucacgagaguacacaaaacauuuaauaagaguagaaaacuggaucuuuaggaauccugguuuugcacuagcagcagcagcaaucgcauggcuacucggaaguaguacgagucaaaaaguaaucuaucuaguaaugauuuuacuaauagcacccgcuuacucaauaagguguauagguguaucaaauagagauuuuguggaagguaugagugguggaacauggguugauguaguacuagaacauggaggaugugucacaguuauggcucaagauaaaccaaccguugauauagaguuaguuacuacuaccguuuccaauauggcagaaguaagaagcuacugcuaugaagcaagcaucucagauauggcaucagauucaagaugcccaacccagggagaagcauauuuagacaaacaaucagauacacaauauguaugcaaaaggacauugguugauagaggaugggguaauggaugcggauuauuuggcaaaggaucucuaguaaccugugcuaaauucgcaugcucuaaaaaaaugacaggaaaaucgauucaaccggaaaaucuugaauaccgaauaaugcuuucaguacauggaagccaacauucaggaaugaucguaaacgauacaggucacgaaacagaugagaauagagcuaaaguagaaauaacuccaaauagcccacgugcugaagcuaccuuaggaggauuugggucuuuaggauuagauugcgaaccacgaacaggauuagauuucucagaccucuauuaucucacaaugaacaauaaacauugguuaguccauaaagaaugguuccaugacaucccacuaccauggcacgcaggugcggacacuggaacaccgcacuggaacaacaaagaagcacuagucgaauucaaggaugcucacgcaaaaagacaaacaguaguaguacugggaucacaagaaggagcaguacacacagcuuuagcaggagcauuagaagcagaaauggacggagcaaaaggaagauuaagcagcggacaucuuaaauguagauuaaaaauggauaaauugagauuaaaaggagucucguauucauuaugcacagccgcauuuacauuuacaaaaauacccgccgaaacacuacauggaacaguuacugucgaaguacaauaugcagggacagacgguccauguaaaguaccugcacaaauggcaguugacaugcaaacacuaacaccaguaggaagauuaaucacagcaaacccaguaauaacagaaucuacagaaaacaguaaaaugauguuagaauuagauccaccuuuuggcgauuccuauauaguaauuggaguaggagaaaaaaaaauuacacaucauuggcauagaagugguucaacacuaggcaaagcuuuuucaaccacacuaaaaggugcucagcgacuagcagcacuuggagauacagcaugggauuucggaaguaucggaggagucuuuaacucaauaggucgagcaguucaucaaguauucggcggagcauuuagaacacuauuugguggaaugucauggauaacacaaggacuaaugggagccuuauuauuauggaugggaguaaaugcgagagauagaaguauugcauuagcauuuuuagcaacugguggaguacuaguauuuuuagcaacuaacguacaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4696 - RNA, 2359 nt, Artificial Sequence
  ZIKV (strain ZikaSPH2015) Polyprotein(93-804) mRNA Design 1 opt
gggagaaagcuuaccaugagaauuauaaacgcucgaaaagaaaaaaaaagacgaggagcagauacaaguguugguauaguagguuuauuguuaacuacugcaauggcagcagaaguaacaagacgaggaagcgcuuauuauauguaucuagacagaaaugaugcaggagaagcgauaaguuucccaacuacauuagguaugaauaaauguuacauacaaauaauggauuuagggcauaugugugaugcaacaaugaguuaugaaugcccaauguuagaugagggaguagaacccgaugacguagauugcuggugcaacacuacaagcacauggguaguauaugguacaugucaucauaaaaaaggcgaagcaagaagaagccgaagagcaguuacacuaccaucacauucaacaagaaaacuucaaacgcgaucacagacuuggcuagaaucaagagaauauacaaaacaucuaauuaggguagaaaauuggaucuucagaaacccaggauuugcgcuagcagcugcugcuauugcuugguuauuaggaucaucaacaagccaaaaaguaauuuaucuugugaugauucuacuaauugcacccgcauauucuauacgcugcauaggagugucgaaccgagauuuugucgaaggaauguccgggggaaccuggguagauaucguauuagaacauggagguuguguuacugugauggcacaagauaaaccaacaguagauauagaauuaguuacaacaacaguaagcaauauggcagaaguuagauccuacuguuaugaagcauccauuagcgauauggcuagugauagcagauguccaacacaaggagaagcuuacuuagauaaacaaagugacacacaauauguaugcaaaaggacauugguagaccgaggauggggcaauggaugcgguuuauucgguaaaggcucauuaguaacuugugcaaaauuugcguguucaaaaaaaaugacaggaaaaaguauacaaccagaaaauuuagaauacagaauaauguuaucaguacacggaucccaacacucaggaaugauaguaaaugacacaggacaugaaacagaugaaaacagagcaaaaguagagauaacaccaaauucaccaagagcugaagccacauuaggaggauucggaaguuuagguuuagacugugaaccaagaacuggauuagauuuuagcgacuuauauuauuuaacaaugaacaauaaacauugguuaguacauaaagaaugguuucaugauauaccauuacccuggcaugcaggagcugauacagggacuccccauuggaacaauaaagaagcacuuguagaauucaaggaugcacaugcgaaaagacaaacaguaguagucuuaggcagccaagaaggggcaguucacacagcauuagcaggagcuuuagaagcggagauggauggcgcaaaaggaagauuaagcucaggccacuuaaaaugcagguuaaagauggacaaauuaagauuaaaaggaguaaguuauagccuaugcacagcagcauuuacauucacuaaaauaccagccgaaacauuacacggaaccguuacuguugaaguacaauacgcaggaacagacggacccugcaaaguaccagcucaaauggccguagauaugcaaacauuaacucccguugggagacuaauaacagccaauccaguaauaacagaaaguacugaaaauucaaaaaugauguuagaauuagauccaccuuuuggagacucauacauaguuauagguguaggggaaaagaaaauaacacaccacuggcacagaucaggcucaacuauugguaaagcauuugaagcuacagucagaggcgcgaaaagaauggcaguacuaggagauacagcaugggauuucggaucaguuggaggggcauuaaacaguuuaggaaaaggaauacaucaaaucuucggagcagcuuucaaaucuuuauuuggagguaugucuugguuuucucagauacuaauagguacauuauuaaugugguuaggacuaaauacaaaaaaugggucaaucucuuugauguguuuagcacuagguggaguguugauauuuuuaucaacagcaguaagugcagacguagguuguucaguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4697 - RNA, 2356 nt, Artificial Sequence
  ZIKV prME variant mRNA Design 1 opt
gggagaaagcuuaccaugauaauuaacgcuaggaaagaaaaaaaacgaagaggggcagauacauccguaggcauaguagguuuguuauuaacaacagccauggcagcagaaguaacacgaagaggcucagcauacuacauguauuuagauagaaaugaugcaggagaagcaauaagcuuuccaacuacauuaggaaugaauaaauguuauauacaaaucauggaucuaggacacaugugugaugcgacaaugucauaugaaugcccaauguuggaugaaggaguugaaccagaugaugucgauugcugguguaauacaacaaguacauggguaguauauggaacaugccaucauaaaaaaggagaagccagaagaagcagacgcgcaguaacacucccaucucauaguacaagaaaacuacaaacaagaucucaaaccuggcuagagagcagagaauacacaaaacauuuaauaagaguagagaauuggauuuucagaaauccuggauuugcccuggcagcagcagcuauugcauggcuacuugguucgagcacgagccaaaaaguaaucuaucucguuaugauacuacuaauagcuccagcuuacagcauaagauguauuggaguaucaaauagagauuuuguagaagguaugucaggaggaacauggguagauaucguuuuagaacauggaggauguguaacaguaauggcgcaagacaaaccaacgguagacaucgaauuaguaacaacgacaguaaguaauauggcagaaguaagaaguuacugcuacgaagcaaguauuucagauauggcaucagacucacgauguccaacacaaggagaagcauauuuggauaaacaaucagacacacaauauguaugcaaaagaacacuaguagacagaggaugggggaacggauguggacuuuuuggaaaagguucuuuaguaacaugugcaaaauuugcgugcucaaaaaagaugacaggaaaaaguauacaaccagaaaaucuugaauauagaauaauguuaucaguacacgggagccagcauagcggcaugauaguuaacgacacuggacacgaaacagacgaaaacagagcuaaaguagaaauaaccccaaauagucccagggcagaagcaacguuaggaggauuuggaaguuuaggacuagacugugaaccacgaacaggacuagauuuuagcgaucuauacuacuuaacaaugaacaacaaacacuggcuaguccauaaagaaugguuucaugacauaccguuaccauggcaugcaggagccgacaccggaacuccacauuggaauaacaaagaggcauuaguagaauuuaaagaugcacaugcaaaaagacagacuguaguaguacuaggaagucaagaaggagcuguacacacagcacuugcaggagcauuagaagcagaaauggacggagcaaaagggcgguugucauccggacaucuaaaaugucgauuaaaaauggacaaauuaaggcuuaaaggaguaucuuacagucuaugcacagcagcauuuacauuuacaaaaauaccagcagaaacauuacaugguacaguaacaguugaaguacaauaugcaggaacagauggcccauguaaaguuccagcacagauggcaguagauaugcaaacuuuaaccccaguaggaagauugauaacagcuaaucccguaauaacagaaaguacagaaaauucaaaaaugauguuagaacuggauccaccauuuggagauagcuauauaguaauaggaguaggagagaaaaagauaacacaucauuggcacagaaguggaagcacaaucggaaaagcuuuugaagcaacgguaaggggcgcaaaaagaauggcaguauuaggagacaccgcgugggauuuuggaagcguaggaggagcauuaaauaguuuaggaaaaggaauacaucaaaucuucggagcugcauucaaaucauuauuuggugguaugucaugguuuucacaaauacuaauagguacccuucuaaugugguuaggauuaaauaccaaaaacggcagcauaagcuuaauguguuuagcauugggugguguuuuaauuuuuuuaucuacagcaguuucagcagaugucgguuguagcguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4698 - RNA, 2353 nt, Artificial Sequence
  ZIKV prME variant mRNA Design 1 opt
gggagaaagcuuaccaugauaaaugcaagaaaagaaaaaaaacgaagaggagcagacacaagugucggaauaguagguuuauuauuaacuaccgcaauggcggcagaaguaacgagaagaggaucugcauauuacauguauuuagaucguaaugaugcuggagaagcaauaucuuucccaacaacacuaggaaugaauaaaugcuauauucaaauaauggaccuaggacauaugugcgaugcaacaaugaguuaugaauguccaauguuagacgaaggaguagaaccagacgauguggacuguugguguaauacaacuagcacguggguagucuacggaacaugccaucauaaaaaaggggaagcaagaagaaguagacgagcaguaacguuaccaucacauagcaccagaaaauuacaaaccaggucacaaacuuggcuagaaucacgagaauacacaaaacaucuaauuagaguagaaaacuggauauuucgaaacccgggauuugccuuagcugcagcagcaauagcauggcuauuaggaucaaguacuucacaaaaaguaauuuaucuaguaaugauacuauuaauagcgccagcauauucaauaagguguauuggaguuagcaauagagauuuuguagaaggaaugaguggaggaacuugggucgauaucguacuagaacauggaggauguguaacaguaauggcacaagacaaaccaacaguagauauagaacuaguuacaacaacaguaaguaauauggccgaagugagaagcuauuguuaugaagccucaauaucagauauggcaagugacucaagguguccaacucaaggagaagcauaucuggauaagcaaucagacacacaauaugucuguaaaagaacguuaguagauagagguuggggaaauggauguggucucuucggaaaaggaucauuaguaacaugugcaaaauuugccugcagcaaaaaaaugacaggaaaaagcauacaaccugaaaaccuggaauauagaauaaugcucucaguacaugguagccaacauucagguaugauagugaaugauacaggacaugaaacugaugaaaaucgagcaaaaguagaaaucacgccuaauaguccgagagcugaagcuacacuaggaggauuuggaaguuuaggauuagacugugaaccaagaacaggauuagauuuuagugaccucuacuauuuaacaaugaauaauaaacauuggcucguacauaaagagugguuucacgacauaccauuaccauggcacgcaggugccgauacaggaacuccgcauuggaauaacaaagaagcauugguugaauuuaaagaugcacaugcaaagagacaaacaguaguuguuuuaggaagccaagaaggagcaguccacacagcuuuagcaggagcuuuagaggcagaaauggauggagcaaaaggaagacuuagcucuggccaccuaaaaugcagauugaaaauggauaaacugagacuaaaaggaguaucuuauagucuauguacagccgcauucacauuuacuaaaauuccagcagaaacuuuacaugguacaguaacuguagaaguucaauaugcaggaacagauggcccuuguaaaguaccugcccaaauggccguagauaugcaaacauuaacaccaguaggaagauuaauaacagcaaauccaguaauaacagaaagcaccgaaaauagcaaaaugauguuagaauuagauccaccauuuggugauaguuauauaguaauuggaguaggcgaaaaaaaaauaacacaucacuggcauagaucagggucaacaauagguaaagcauuugaagccacaguaagaggagcaaaaagaauggcaguuuuaggagauaccgccugggacuuugguucaguaggaggagcucuuaauucuuuaggaaaaggaauacaccaaauauuuggcgcagcauuuaagaguuuauucggaggaaugucaugguuuucacaaauucuaauaggaacguuauuaauguggcuagguuuaaauacaaaaaaugggagcaucucccuaaugugucuugcauuaggaggaguacuuauauuuuuaagcacugcaguaagugcggacguagguuguaguguagauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4699 - RNA, 2350 nt, Artificial Sequence
  ZIKV prME variant mRNA Design 1 opt
gggagaaagcuuaccaugaacgcuagaaaagaaaaaaaacguagaggugccgacacaagcguaggaauuguaggguuauuauuaacaacagcaauggcagcugaaguaacuagaagagguucagcauacuauauguacuuagauagaaaugacgcuggagaagcaauaaguuuuccaacaacauuagguaugaauaaauguuauauacaaauaauggaucuuggucauaugugcgaugccacaaugucguacgaauguccaaugcuagaugaaggagucgaaccagaugauguagauuguugguguaacacaacaagcacuuggguaguguaugguacaugucaucacaaaaaaggagaggcaagaagaaguagacgggcuguuacacuucccagccacucuacgagaaaacuacaaacacgaagucaaacauggcuagaaucaagagaauacacaaaacaccuaauaagaguagaaaauuggauauuuagaaauccaggguucgcucuugcagcagcagcaauagcauggcuauuaggaaguaguacuagucaaaaagugauauaucuaguaaugauacuuuuaauagcgccagccuacagcauaagauguaucggaguaaguaauagagauuuugucgaaggaaugucuggagguacuuggguagacauaguacuagaacacgguggaugcgugacuguaauggcacaggacaaacccacaguagacauugaauuaguaacaacaacaguaucaaacauggcagaaguaagaucauauuguuaugaagcaaguauaagugauauggcaucagauagucgauguccaacacaaggagaagcuuauuuagauaaacaaagugauacgcaauacguauguaaaagaacgcuaguagacagggguuggggaaacggaugugguuuauucgguaaggguucauuaguaacaugugccaaauuugcauguaguaaaaaaaugacuggaaaaucuauacaaccugaaaauuuagaauacagaauuauguuaucgguucauggaagccagcacagcggaaugauaguuaaugauacaggacaugaaacggaugaaaauagagcaaaaguagaaauaacaccaaacaguccaagagcagaagcaacauuaggaggauuuggaagcuuaggauuggauugugagccgagaacaggauuagauuuuagcgaucuauacuauuuaacaaugaauaacaaacauugguuaguacauaaagaaugguuucacgauauuccacuaccguggcaugcaggagcagauacagguacaccgcauuggaauaacaaagaggccuuaguugaguucaaagaugcucaugcuaaaagacaaacggucguaguacuaggaucacaagaaggagcaguacacacagcacuagcaggagcucuugaagccgaaauggauggugcgaaaggacgauuaucaaguggacauuuaaaaugcagacuaaaaauggauaaauugagauuaaaaggaguaaguuacagcuuauguacagcugccuuuacuuucacaaaaaucccagcugaaacauuacauggaacaguuacaguugaaguucaauaugcaggaacagaugguccauguaaaguaccagcacaaauggcaguagauaugcaaacauuaacuccaguaggaagauuaauaacugccaauccuguaaucacagaaaguaccgaaaauucaaaaaugauguuagaauuggauccgccauuuggagauucuuauauagucauagguguaggugaaaaaaaaauaacacaucauuggcauagaagugguucaacaauagguaaagcauucgaagcaacaguaaggggagcaaaaagaauggcaguacuaggagauacagcuugggacuuugguagcgucggaggugcuuuaaauagcuuaggaaaagguauucaucaaauauuuggugccgcauuuaaaaguuuauucggagggaugaguugguuuagucaaauacucauuggaacucuuuugauguggcuaggauuaaacacaaaaaauggaaguauuucacuaauguguuuagcauuaggaggaguauuaauauuccuaucuacagcagucucagcugauguaggaugcucagucgacuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4700 - RNA, 2347 nt, Artificial Sequence
  ZIKV prME variant mRNA Design 1 opt
gggagaaagcuuaccauggcaagaaaagaaaagaaaaggagaggagcagacacaaguguaggaauaguagguuuauuacugacuacggcaauggcagcagaaguuacaagaaggggaagcgcauauuauauguauuuagauagaaaugaugcaggagaagcaauaucauucccaaccacauuaggaaugaacaaauguuacauacaaauaauggaccucggacauaugugcgaugccacaaugucauaugaaugcccgauguuagacgaaggaguagaaccagaugauguagauuguugguguaauacuacuagcacauggguaguauacggaacaugccaucauaagaaaggagaagcucgaagaucuagaagggcuguaacuuuacccucacauucaacacguaaauuacagacaagaagccaaacauggcuagaaucaagggaauauacaaaacacuuaauuagaguagaaaauuggauauucagaaauccaggauucgcguuagcagccgcagcgauagcuugguuauuaggaucaaguacaucucaaaaaguaauauaucuagucaugauacuacuaauagcgccagcuuacaguauaagaugcauaggaguaaguaacagagacuuuguagaaggaaugucaggaggcacauggguagacauaguacuagaacaugguggauguguaacagugauggcacaagacaaaccaacaguagauauagaauuaguaacaacgacaguaagcaauauggcagaaguaaggaguuauuguuaugaagcaucaauuucagauauggcaagcgauucaagaugucccacucaaggugaagcauaucuagauaaacaaagcgauacgcaauauguauguaaaagaacuuuaguagaucgaggcugggguaacggaugcgguuuauuuggaaaagggagcuuagucacaugugcaaaauucgcauguucgaagaaaaugacuggaaaaaguauacaaccugaaaaucuagaauacagaauuauguuaucaguacauggaagucaacauaguggaaugauuguaaacgauacaggucaugaaacggacgaaaaucgcgcaaaaguagaaauaacaccuaauaguccacgagcagaagcuacuuuaggggguuucgggucauuaggauuggacugugaaccaagaacagguuuagacuuuagugaccuauauuacuuaacaaugaacaauaaacacugguugguacacaaagaaugguuucaugacauaccauuacccuggcaugcaggagcagacacuggaacuccacauuggaauaauaaagaagcgcuaguagaauuuaaagaugcacaugcaaaaagacaaacuguaguuguccuaggaucacaagaaggagcaguacauacagcauuagcuggagcauuagaggcagaaauggauggagcaaaaggaagauuauccagugggcaucuaaaaugcagguuaaaaauggauaaacuuaggcuaaaaggaguaucuuacucacuauguaccgcugcauucacauuuacaaaaauuccugcagaaacauuacauggaacagugacaguagaagugcaauaugcuggaacugacgguccauguaaaguuccagcacaaauggcaguagauaugcaaacauuaacuccuguagguagacuuauaacagcaaacccaguaauaacagaaaguacagaaaauucaaaaaugaugcuagaauuagauccaccauucggagauagcuauauagugauuggaguaggugaaaagaaaauuacacaccacuggcacaggagugguaguacaauaggaaaagcguuugaagcaacuguaagaggugcaaaaagaauggcugucuuaggugacacugcaugggauuuugguaguguuggaggagcuuuaaauucacuaggaaaagguauacaccaaauauucggagcagcauuuaaaagucuauuuggcgguauguccugguuuucacaaauauuaauaggaacguuauuaaugugguuaggacuaaacacgaaaaauggaagcauaucauugauguguuuagcucuaggaggaguuuuaauauuucuuucaacagcagucucagcagauguuggauguucaguagacuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4701 - RNA, 2344 nt, Artificial Sequence
  ZIKV prME variant mRNA Design 1 opt
gggagaaagcuuaccaugagaaaagaaaaaaaaagacgaggagcagacacaucagucggaauuguaggacuacuuuuaacaacagcaauggcagcagagguuacuaggagagguucagccuauuauauguauuuagauagaaacgaugcuggcgaagcaauuaguuuccccacaacauuaggaaugaauaaauguuauauacaaauuauggauuugggucauaugugcgacgcaacaaugaguuaugaaugccccaugcuggaugaaggggucgaaccagacgauguagauuguugguguaacacaacaucaaccuggguaguauacgggacaugucaucacaaaaaaggagaagcgagacgaagcagaagagcaguuacacuaccaagucacucaacacgaaaacuacaaacacgaucacaaacaugguuagaaaguagagaguacacaaaacaucuuauucgaguagagaauuggauauuuaggaauccaggauuugcauuagcagcagcagcaauagcaugguuauuagguucaucaacaagucaaaaaguaauauaccuuguaaugauacuacuuauagcaccugcuuauaguauaagauguauuggaguaucaaauagagacuuugucgaaggaaugaguggaggcacguggguagauauaguauuagaacacggaggauguguaacagucauggcacaagacaaaccuacaguagacaucgaacucgucacuaccacaguaucaaauauggcagaaguaagaucauacuguuaugaagccaguauaagugauauggcaagugacucaagauguccaacacaaggugaagcauaucucgauaaacaauccgauacucaauauguauguaaaagaacauuaguagauagaggauggggcaauggauguggacuuuuuggaaaagggucacuaguaacaugcgcaaaauuugcauguaguaaaaaaaugacagguaaaucaauacaaccagaaaaccuugaauaucgaauaauguuaaguguucauggaagccaacacucgggcaugaucgugaacgacacagggcacgaaaccgaugagaauagagcaaagguagaaauaacaccaaauagcccaagagcagaagcuaccuuaggaggauucggaucauuaggcuuagauugugaaccaagaacaggguuagacuuuucagaucuauacuaucuaaccaugaauaauaaacauuggcuaguucacaaagaaugguuucaugauauaccauuaccauggcacgcaggagcagacacgggaacaccacauuggaacaacaaagaagcauuaguggaauuuaaagaugcacacgcaaaaagacaaacuguugugguacuaggaagucaggaaggagcaguacauacagcauuagcgggagcgcuagaagcagaaauggauggagcaaaaggaagacuaucaucuggucacuuaaaauguagauugaaaauggauaaguuaagauuaaaggggguuagcuauucucuauguacagcggccuucacuuuuacaaaaauuccggcagaaacacugcauggaacaguaacaguagaaguccaguaugcagguacagacggaccauguaaaguacccgcccaaauggcaguagauaugcaaacauugacuccaguaggaagacucauaaccgcuaauccgguuauaacagagaguacagaaaacucaaaaaugaugcuagaacucgauccgccauucggagauucguauauaguuauagguguuggagaaaaaaaaauaacacaccauuggcauagaucaggcuccacaauaggaaaagccuuugaagcuaccguaaggggagcaaaaagaauggcaguauuaggagauacugcaugggauuucggaucaguuggaggagcacuaaauagcuuaggaaaaggaauacaucaaauauuuggagcagcauuuaaaucuuuguuuggaggaaugucaugguucagucaaauauuaauaggaacguuauuaaugugguuaggucugaauaccaaaaauggaagcauuaguuuaauguguuuagcauuaggaggaguauuaauauuucuaucgacagcuguaucagcagauguggguuguucaguagauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4702 - RNA, 2341 nt, Artificial Sequence
  ZIKV prME variant mRNA Design 1 opt
gggagaaagcuuaccaugaaagaaaaaaaaagaagaggagcagauacaucaguaggaaucguaggauuacuauugacaacagcuauggcagcagaaguaacaagaagaggaucggcauauuauauguauuuagaucgcaacgaugcuggagaagcaauuucauucccaaccacuuugggaaugaauaaaugcuacauacaaauaauggauuugggacauaugugugacgcgacuaugucauacgaguguccgaugcuagaugaaggaguagaaccugaugacguagauuguugguguaauacuacaagcacuuggguagucuaugguacgugccaucauaaaaaaggugaagcucgaagaagcagaagagcaguuacuuuaccuucacacucaacaagaaaauuacaaacgagaagucaaacaugguuagaaucaagagaauauacaaaacauuuaauaagaguugaaaauuggauauuuagaaauccugguuuugcauuagcugcggcagcaauagccugguuauuaggaucaucaacuagucaaaaaguaauuuauuuaguaaugauuuuauuaauagcaccugcguauaguauaagauguauaggaguaaguaauagagauuuuguagaagguaugucaggaggaacauggguagacauaguauuggaacauggggggugcguaacagucauggcucaagacaaaccaacaguagacauagaauuaguuacaacaacuguauccaauauggcagaaguaagaagcuauuguuacgaagcuucuauaagcgacauggcuucagauucaagauguccuacacaaggugaagcauauuuagacaaacaaagugauacccaauacguaugcaaaagaacauugguggauagaggaugggguaauggaugcggauuauuuggaaagggaucacuaguaacaugugcaaaauuugcauguagcaaaaaaaugacaggaaaaaguauacaaccggaaaaucuagaauauagaauaauguuaucgguacacgguagucaacauucaggaaugauaguaaaugauacaggacaugaaacagaugagaacagagcuaaaguugaaauuacaccgaauucuccaagagcagaagcaacgcuaggaggauuuggaagucuagguuuagauugcgaaccaagaacagguuuagacuucagugacuuauacuacuuaacaaugaacaauaaacauugguuaguacacaaagaaugguuucaugauauaccacuaccauggcaugcaggagcggauacuggaacaccacacuggaacaauaaagaagcauuaguagaauuuaaagaugcacaugcaaaaagacaaacaguaguagugcucgguucacaagaaggagcagugcacacagcauuggccggagcacuagaagcagaaauggauggagcaaaaggaagacuaucaucaggacaucuaaaaugcaggcuaaaaauggauaagcuuagauuaaaaggaguaucauauucacugugcacagcagcuuucacauucaccaaaauuccugcagaaaccuugcacgguaccguaacaguagaaguacaguaugccgggacagauggaccauguaaaguaccagcgcaaauggcggucgauaugcagacucuaacaccagugggaagguuaauaacagcuaaucccgugauaacagaaucaacagaaaauaguaaaaugauguuagaacuagauccuccauuuggagauucauacauaguaauaggaguuggagaaaaaaaaauaacacaucacuggcauaggagcggcucaaccauuggaaaagcauucgaagcuacaguaagaggcgcaaaacguauggcaguauuaggagauacagcaugggauuuuggaucaguuggaggugcauuaaacucacucggaaaaggaauacaucaaauauucggagcugcuuucaaauccuuguucggagguaugaguugguuuucucaaauauuaauaggaacacuauugaugugguuaggauuaaauacaaaaaacggaagcauaucauuaauguguuuagcauuagggggugucuuaauuuucuuaucaacagcagugucagcagaugucggguguagcguugauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4703 - RNA, 2338 nt, Artificial Sequence
  ZIKV prME variant mRNA Design 1 opt
gggagaaagcuuaccauggaaaagaaaagaagaggagcagauacaucagugggaauuguagggcuauuauuaacaaccgcaauggcagcagaaguaacaagaaggggaagcgcauacuauauguauuuagaccguaaugacgcuggagaagcgauuuccuuucccacaacauuaggaaugaauaaaugcuacauacaaauaauggacuuaggacauaugugugaugccacaaugucauacgaauguccaaugcuugacgaaggaguagaaccagaugacgucgacuguuggugcaauacaacaucuacuuggguuguuuaugggacuugucaucacaagaaaggagaggccagacgaagucguagagcaguaacuuuaccaagccacucaacaagaaaacuacagacuagaagucaaacgugguuagaaucaagagaauauacaaaacauuuaauacgaguggaaaacuggauauucagaaacccuggauucgcauuggcagcagcugcaauugcaugguuauuaggaucaaguacaucacaaaaaguaauauauuuaguuaugauauuacuaauugcacccgcuuauucaauaagauguauaggaguaucuaacagagauuuuguugaaggcaugagcggaggaacauggguagauauaguauuggaacaugggggaugcguuacaguaauggcacaagauaaaccaacaguggauauagaauuagucacaacaacaguuaguaacauggcagagguacgaucuuauuguuacgaagcaaguauaagugauauggcaucggauaguagauguccuacacaaggagaggcuuauuuagacaaacaaagugauacacaauauguuuguaaaagaacacuuguugauagagguugggguaacgguugcggauuauuugguaaaggcucacugguuacgugugcaaaauucgcauguagcaagaaaaugacuggaaaaaguauacaaccagaaaaucuagaauauagaauaauguuaaguguacacggaagccaacauucaggaaugauaguaaaugacacaggacacgaaacagacgaaaauagagcaaaaguugaaaucacuccuaauucaccaagagcagaagcaacacuaggagguuuuggaucucuaggccucgacugugaaccacgcacaggauuagacuuuucagacuuauacuaucuuacaaugaauaacaaacauuggcuaguacauaaagaaugguuccacgacauuccacuaccauggcacgcaggagcagacacaggaacaccacauuggaacaacaaagaagcacuuguagaauuuaaagaugcccaugccaaaagacaaacaguaguaguauuaggaucacaagaaggcgcuguacauacugcccuagccggcgcacuagaagccgaaauggauggcgcaaaaggaagacuaucaagugggcauuuaaaauguagacuuaaaauggauaaacugcgacuaaaaggaguaucguacucauuauguacggcagcuuuuacauuuaccaaaauaccagcagaaacacuacacggaacuguaacgguggaaguucaauacgcuggcacagauggaccuuguaaaguaccagcacaaauggcaguagacaugcaaacuuuaacaccaguaggaaggcuaauaacagccaacccgguaauaacugaaaguacagaaaauucaaaaaugaugcuagaauuagauccuccguucggagauagcuacauaguaauugguguaggagaaaagaaaauaacccaucauuggcaccgaaguggaucuacaaucggaaaagcauucgaagcaacaguaagaggagccaaaagaauggcuguacuuggggauacagcaugggauuuuggaucaguagggggagcgcucaauaguuuaggaaaaggaauacaucaaauauuuggagcagcuuuuaaaaguuuauuuggaggaaugaguugguucucacaaauauuaauagguacccuacuaaugugguuaggacuuaauacuaaaaauggaaguauaucauugauguguuuagcauuagguggaguucuaauauuuuuaucaacagcaguaagugcagauguagguugcucaguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4704 - RNA, 2335 nt, Artificial Sequence
  ZIKV prME variant mRNA Design 1 opt
gggagaaagcuuaccaugaaaaaaaggagaggagcggauacaucaguaggaauuguaggauuacuguuaacuacugcaauggcagcagaaguuacaagaagaggaagugccuauuauauguauuuggacagaaacgacgcaggagaagcaauaucauuuccaacaacauuaggaaugaauaaauguuauauacaaauaauggauuuaggacauaugugugaugccacaaugucuuaugaauguccuauguuagacgaaggaguagaaccugaugacguugauuguuggugcaacacaacaaguacuuggguaguauauggaacaugccaucacaaaaaaggggaagcaaggagaucaagaagggcaguuacauuaccaucucacucuacgagaaaauuacagacaagaucacaaacgugguuagaaaguagagaauauacaaaacacuugauacgagucgaaaauuggaucuuccggaauccagguuuugcgcuagcagcagcagcaauagcauggcuauuaggaaguucaacaagucaaaaaguaauauacuuagugaugauuuuguuaauugcaccugcguacaguauaagauguauaggagugucuaauagagacuuuguagaaggaaugucaggcggaacauggguagauauuguacuagaacacggaggaugcgugacaguaauggcacaagacaaacccacaguagauauagaauuaguaaccacaacaguaagcaauauggcagaaguaagaagcuauuguuaugaggcaaguauaucagauauggcaagugauucaagauguccaacucagggagaagcuuauuuagauaaacaaagcgacacacaauauguauguaaaagaacacuuguagacagaggauggggaaacgggugcgguuuauuuggaaaagguucauuaguaaccugugcaaaauuugcaugcucuaaaaaaaugacuggaaaaaguauacaacccgaaaauuuagaauauagaauaaugcuaaguguacacggaucacaacauucagggaugauaguaaaugauacgggacaugaaacagaugaaaauagagcaaaaguagaaauaacucccaacaguccaagagcagaagcgacacuagguggguuugguaguuuagggcuggacugcgaaccaagaacggguuuagacuuuucagauuuguauuaucuaacuaugaacaauaaacauugguuaguacauaaagagugguuucacgacauuccgcuuccauggcaugccggugcagacacaggaacaccacauuggaacaauaaagaagcauuaguagaauuuaaagaugcacaugcaaaaagacagaccguaguagucuuaggaagucaagaaggagcgguacacacugcacuagcaggagcacuagaagcagaaauggacggagcaaaaggaagacugucaaguggacaccuaaaauguagguuaaaaauggauaaacuaagauuaaaagguguuucauauucacuauguacagcagcauuuacauuuacgaaaauaccagcagaaacauuacacgguacaguaacaguagaaguacaguaugcaggaacagauggaccuugcaaaguaccugcacagauggcuguagauaugcaaacacuuacaccaguaggcagacuaauaacagcaaauccaguaauuaccgaaaguaccgaaaauucaaaaaugauguuagaacuugauccaccuuuuggagacagcuauauaguaauaggggugggagaaaaaaaaauaacacaccauuggcauagaaguggaaguaccauagggaaagcauuugaagcaacaguuaggggagcaaaaagaauggcgguauuaggggacacagcuugggacuuuggaaguguugguggagcauuaaauucauuaggaaaaggaauacaucaaauauuuggagcagcauuuaaaucauuauuuggagggaugaguugguuuagucaaauauuaauaggaacacuauuaaugugguuaggguuaaauacuaaaaauggcaguauaagcuuaauguguuuagcacuagggggagugcuaauauuucuaaguacagccguaagugcagacgucggaugcaguguugauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4705 - RNA, 2332 nt, Artificial Sequence
  ZIKV prME variant mRNA Design 1 opt
gggagaaagcuuaccaugaaaagaagaggugcagacacgaguguuggaauagugggauuguuacuaacaacagcaauggcugcagagguuaccagaagaggaucugcauauuauauguauuuagacagaaacgaugccggugaagcaauaaguuucccaacgacucuaggaaugaauaaaugcuacauacaaauuauggacuuaggacauaugugcgaugcaacaaugagcuaugaaugcccaauguuagaugagggaguagaaccagacgauguagauuguugguguaauacaacaucaacuuggguaguuuacgguacuugccaucauaaaaaaggagaagcaagaagaucaagaagagcaguaacauugccuagucauucaacacgcaaacuccaaacaagaucacaaacaugguuggaaucaagagaauacacaaaacauuuaauaagaguagaaaauuggaucuuucgaaauccaggauuugcacuagcagcagcagcaauagcaugguuauuaggaaguucuacaucacaaaaaguaauauaccuagucaugauacucuugauagccccugcauauucuauaagaugcauaggaguuaguaauagagauuucguugaaggaauguccggaggaacuuggguugauauagucuuagaacacggaggauguguaacuguaauggcacaagauaaaccaacuguagauauagaauuaguuacaacaacaguaucuaauauggcagagguacgaucauacuguuaugaggccaguauaagugauauggcauccgacucacgauguccaacacaaggagaagcuuaccuugauaaacaaagugauacgcaauauguauguaaaagaacauuaguagaucgaggauggggcaauggcugcggauuauuuggcaaaggauccuuaguaacaugugcaaaauucgcauguagcaaaaaaaugacaggaaaaucaauacaaccagaaaauuuagaauauagaauaaugcuaucaguacauggaucacaacauagcggaaugauaguuaacgauaccggacaugaaaccgacgaaaauagagcaaaaguagaaauaacaccaaacagcccaagggcagaagcaacauuaggcggauuuggauccuuagguuuagacugugaaccacgcacugguuuggauuuuagugauuuauacuaccuuacaaugaacaauaaacauugguuaguccacaaagaaugguuucaugauauaccauuaccauggcaugcuggugcagauacugggaccccacauuggaauaauaaagaagcauuaguagaguuuaaagaugcacaugcaaaaagacaaacagucgucguccuagggagucaagaaggagcaguacacacagcacuagcaggagcccuugaagcagaaauggacggagcaaaaggaagauuaaguucaggacauuuaaagugucgccuuaaaauggacaaauuaagacuaaaaggagucaguuauucgcuauguaccgcagcguucacguuuacaaaaauuccggcagaaacucuacaugguacuguuacuguagagguccaauaugcaggcacagacggaccauguaaaguaccagcucaaauggccgucgacaugcaaacacucacuccaguaggaagauuaauaacagcaaauccaguaauuacagaaucaacagaaaauaguaaaaugauguuagaauuggauccacccuuuggagacaguuauauuguaauaggagucggagaaaaaaaaauaacacaucauuggcaucgaucaggaucaacgauaggaaaagcauuugaggcaaccgucagaggagcuaaaagaauggcaguucuaggagacaccgcaugggauuucggaucagucggaggggcacuaaauucucucgguaaagggauacaucaaauauuuggagccgcauuuaaauccuuauucggagguaugaguugguuuucacaaauccuaauaggaacauugcuaauguggcugggacuaaauacgaaaaaugguaguauaucauugaugugcuuagcucuaggagguguauuaaucuuucuuagcacagcaguuucggcagacgucggauguaguguagauuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4706 - RNA, 2329 nt, Artificial Sequence
  ZIKV prME variant mRNA Design 1 opt
gggagaaagcuuaccaugagaagaggagccgacacuucagugggaauuguaggauuauuauuaacaaccgcaauggcagcagaaguuacaagaaggggaucagcauauuauauguaucuugauagaaaugacgcaggugaagccauuaguuuccccacaaccuuagguaugaauaaaugcuauauacaaauaauggauuuaggacauaugugugaugcaaccaugaguuacgaaugcccaauguuagacgaagggguugaacccgaugauguagauugcugguguaacacuacaaguacauggguaguauauggcacaugucaucacaaaaaaggugaagcaagaagaucaagacgagcaguuaccuuaccuagccauaguacacgcaaauuacaaacaagaucacagacuugguuagaaaguagggaauauaccaaacacuuaauaagaguugaaaauuggauauuuagaaaucccggauuugcauuagcagcagcagcaauagcgugguuacuaggcagcucaacuagucaaaaaguaauauaucuaguaaugaucuuauuaauagcuccagcauauucaauaagauguauaggagugagcaauagagauuuuguagaaggaaugaguggagguacauggguagacauaguacuagaacacggaggcuguguaacagucauggcacaagauaaaccaacaguugauaucgaauugguaacaacaacaguaagcaacauggcggaaguaagaagcuacugcuaugaagcuaguauaagcgacauggcaagugauucaagauguccuacacaaggagaagcguaucuagauaaacaaagugauacacaauauguuuguaaaagaacauuaguagauagaggauggggaaauggauguggauuguuugguaaagggucauuggucacuugcgcuaaauuugcauguaguaaaaaaaugacaggaaaaagcauucaaccagaaaaccuagaauauagaauaaugcuuaguguccauggaucacagcauucagguaugauaguaaaugacacaggacaugaaacagacgaaaauagagcaaaaguagaaauaacaccgaacagcccaagagcagaagcuacuuuaggaggauuuggaaguuuaggacuagacugugaaccaagaacaggcuuagauuuuagugacuuauauuauuugacgaugaauaauaaacacugguuaguacacaaagaaugguuccaugauauaccauugccauggcaugcaggugcagauacaggaacaccacacuggaauaacaaagaggcccugguagaguucaaagaugcacaugcaaaaaggcaaacaguuguaguauuaggaucucaagaaggugcaguucacacugcccuagccggagcauuagaagccgaaauggauggagcuaaaggaagauugaguagcggacaucuuaaaugcagauuaaaaauggauaaauuaagacucaaagguguaagcuauaguuuauguacagcagccuuuacauuuacuaaaauacccgcagaaacacuacauggaacaguuacaguugaaguacaauacgcaggaacggaugguccauguaaaguaccugcucaaauggcaguagacaugcagacacuaacgccgguagguagauuaauaacagcgaaucccguuauaacugaaucaacagaaaauucaaaaaugaugcuagaauuagauccaccuuuuggagacagcuauauaguaauaggaguaggagaaaaaaaaauaacacaucacuggcauagaucaggcagcacaauugguaaagcuuuugaagcuacaguucgaggagcaaaaagaauggcaguacuaggagauacagccugggauuuuggaagcguagguggagcuuuaaacucuuugggaaaagguauacaucaaauuuuuggagcugcuuuuaagaguuuguuugguggaaugucgugguuuagucaaauauugauaggcacauuacucaugugguuaggacuaaauacaaaaaacggaucaauaagucuaauguguuuagcacuaggaggaguauuaauauuuuuaucuacagcaguaagcgcagacguuggauguucaguagauuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4707 - RNA, 2326 nt, Artificial Sequence
  ZIKV prME variant mRNA Design 1 opt
gggagaaagcuuaccaugaggggagcagauacaucaguaggaauaguaggauuauuauuaacaacagcaauggcagcagaaguuacaaggaggggaagugccuacuacauguacuuagauagaaacgaugcaggagaagcaauuaguuuuccuacaacauuaggaaugaauaaaugcuauauacaaauaauggacuuaggucauaugugcgacgcaacuaugucuuacgaaugcccaauguuagaugaaggaguagaaccagacgauguagacuguugguguaauaccacaaguacguggguaguauauggaacuugucaucacaagaaaggagaagcaagaagauccaggagagcaguaacuuuaccaucacacucaacgagaaaauuacagacaagaagccaaacaugguuagaaucaagagaauauacaaaacacuuaaucagaguagaaaauuggauauuucgaaauccaggauucgcacuugcggcagcugcuauagcauggcucuuaggaaguucuaccagccaaaaaguaauuuauuuaguaaugauacuuuuaauagcacccgcauauucaauaagguguaucggaguuucuaauagagauuuuguggaaggaaugucaggcggaacuuggguggacaucguuuuagaacacggaggauguguuacaguaauggcucaagauaaaccaacuguagauauagaauuaguaacuacgacagugucaaauauggcagaaguaagaucuuauuguuaugaggcuucaaucagugacauggcaucagauaguagauguccaacacaaggagaagcauauuuagacaaacaaagugacacacaauaugucuguaaaaggacauuaguagacagaggguggggaaauggauguggacucuuuggaaaaggaucucuaguaacuugcgcuaaauuugcauguucaaagaaaaugacaggaaaaucaauacaaccagaaaaucucgaauauagaauuauguuaucaguacauggcucacaacauaguggaaugauaguuaaugauacaggacaugaaacagaugaaaacagagcaaaaguagaaauuacaccuaacucaccuagagccgaagccacacuaggugguuuuggaaguuuaggacuagauugugaaccaaggacaggucuagauuuuagcgacuuauauuauuuaacaaugaauaauaaacauugguugguccauaaagaaugguuccacgauauuccauuaccuuggcaugcaggagcagauacaggaacaccacauuggaauaacaaagaagcauuaguugaauuuaaagaugcacaugcuaaaagacaaacuguaguuguacuuggaucccaagaaggagcaguucauacagcauuagcgggugcacuugaagcagaaauggauggagcaaaagguagacuaucaagcggacaucugaaaugucgacuaaaaauggauaaacugagauugaaaggaguuaguuauaguuuaugcacagcagcauucacauuuacaaaaaucccagcagaaacauuacauggaacaguaacuguagaaguacaauaugccggaacugauggacccuguaaaguucccgcacagauggcgguagacaugcagacauuaacuccaguagguagauuaauaacggcaaauccugucauaacggaaucuacagaaaauucaaaaaugauguuggaauuagacccaccauuuggagauuccuacauaguuauaggagucggugaaaagaaaauaacacaucauuggcacaggagcggaaguaccauugguaaggcuuuugaagcaacaguaagaggagcaaaaagaauggcaguuuugggagauacagcaugggauuucgguaguguuggaggagcucuuaauucuuuaggcaaaggaauacaucaaauauucggagcagcuuuuaaaagucuauucggagggaugaguugguuuagccaaauacuaauuggaacgcuacugaugugguuaggacucaacacuaaaaacgggagcauuaguuuaaugugccuagcauuagguggaguacuaauauuucuaucaacagcaguuucagccgaugucggcuguucaguagauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4708 - RNA, 2323 nt, Artificial Sequence
  ZIKV prME variant mRNA Design 1 opt
gggagaaagcuuaccaugggugcagauacaucaguuggaauaguaggacugcuauuaacaacagcaauggcggcagaaguaacaagacggggaucagcuuauuacauguaucuagauagaaaugaugcaggagaagcaauaucauucccaacgacacuaggaaugaacaaauguuacauccaaauaauggaccuaggacauaugugcgacgccacuaugagcuaugaaugcccaaugcuagaugaaggaguagaaccggaugauguugacuguugguguaauacgacaucaacuuggguaguauacggaacuugucaucauaagaaaggagaagcaagacgaaguagacgagcaguaacacuaccaucacacaguacaagaaaauuacaaacaagaagucagacauggcuugaaagcagagaauauacaaaacauuuaauaagaguagaaaauuggauuuuuagaaauccagguuucgccuuagcugcagcugcgauagcauggcucuugggaucuagcacuucacaaaaaguaauauacuuaguaaugauuuuacuaauugcaccagcauauucaaucagauguauuggagucagcaauagggacuuuguagaaggcaugucagguggaacguggguagauaucguacuagaacacggagggugcguaacaguaauggcacaggauaaaccaacgguagacauagaauuaguaacgacaacgguaucaaauauggcagaaguaagaaguuacuguuacgaggcaucuauuagugacauggcuucagacucacgauguccaacacaaggagaagcauauuuagauaaacaaagugauacgcaauacguaugcaaaagaacauuaguagacagagggugggguaauggaugcgguuuauuuggaaaaggaucauuaguaacaugugcaaaauuugcauguucuaagaaaaugacaggaaaaaguauccaaccagagaauuuagaauacaggauuauguuaaguguacacggaucacaacauucagggaugauaguaaaugacacaggacaugaaacugaugaaaaucgagcaaaaguagaaauaacucccaauucaccaagagcugaagcuacauuagggggauuuggaucacuaggacuagauugugaaccgagaacaggauuagauuuuagugauuuauauuauuuaacaaugaacaauaaacacugguuaguacauaaagaaugguuucaugacauaccauuaccguggcacgcaggggcagauacuggaacaccacauuggaauaauaaagaggcacugguugaguucaaagacgcucacgcaaaaagacaaacaguagucguguuaggcucucaggaaggagcaguacauaccgcguuagcaggcgcacuagaagcagaaauggauggcgcuaaaggcagacuuagcagcggacacuugaaaugcagacuaaaaauggacaaauuacgguuaaaaggcgugaguuauucauuauguacagccgcauucacauucacaaaaauaccugcugaaacuuuacaugggacagugacgguagaaguacaguaugcggggacagacggaccuuguaaaguaccugcacaaauggcaguagauaugcaaacuuuaacaccaguaggaagauuaauaacagcaaauccaguaauuacagaaaguacagaaaauaguaaaaugaugcuagaauuagacccaccuuuuggcgacucauauauagucauaggaguaggugaaaagaaaauaacacaccauuggcacaggaguggaucuacaauaggaaaagcauuugaagccacaguaagaggagccaaaagaauggcaguacuaggagacacagcuugggauuuuggaagcgucggaggagcacuaaauaguuuaggaaaaggaauacaucaaauauucggagcagccuucaaaucauuauuuggugguauguccugguuuagucaaauauuaauaggaacauuauuaaugugguuaggacuaaauacuaaaaacgguaguaucucacuuauguguuuagcccuggguggaguauuaauauuuuuaucaaccgcuguaucagcugauguuggauguucaguagauuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4709 - RNA, 2320 nt, Artificial Sequence
  ZIKV prME variant mRNA Design 1 opt
gggagaaagcuuaccauggcagauacauccguaggaauaguaggacuuuuauuaacaacagcaauggcagcggaaguaacaagaagagguucagccuauuacauguauuuggauaggaaugacgcaggagaagcaauuagcuucccuacaacacuugggaugaacaaauguuauauacaaaucauggaccuaggacauaugugugaugcaacuaugaguuacgaauguccaaugcuugaugagggaguagaaccagacgacgucgauuguuggugcaauacuacaaguacuuggguaguauaugguacaugucaucauaaaaaaggagaagcaagacgcucaaggagagcaguaacauuaccuagucacucaacaagaaaacugcaaacacgaagucaaacauggcucgagagccgagaauauacaaaacaucuaauuagaguagagaacuggauauucagaaauccaggauucgccuuagcggcagcagcaauagcaugguuacuaggaaguucaacaucacaaaaaguaauauaucuagucaugauuuuauuaauagcuccugcauauucuauacgauguauaggagucaguaauagggauuuuguagaaggaaugaguggagguaccuggguagauauuguauuagaacacggaggcuguguaacuguuauggcacaagauaaaccuacaguagauauagaacuaguaacgacaacagugagcaacauggcugaagugagaucauauuguuaugaagcuagcauaagcgauauggccagugauucuagauguccaacccaaggagaagcauacuuagauaagcaaucugauacccaauauguaugcaaaagaacacuaguagaccgaggauggggcaauggaugcggucuauucggaaaaggaagcuuagugacaugugcaaaauuugcauguuccaaaaaaaugacaggcaaaagcauacaaccagaaaauuuagaauacaggauaaugcuaucaguacauggaucucaacauagcggaaugauaguaaaugauacaggacacgaaacugacgaaaauagagccaaaguagagaucacacccaacaguccaagagcagaagcaacgcuaggaggauuuggaagccucggauuagauugugaaccaagaacaggacuagauuucagcgaucuuuacuauuuaaccaugaacaacaaacauugguuaguacauaaagagugguuucaugauauaccguuaccuuggcaugcaggagcagauacaggaacaccacacuggaauaauaaagaagcccuuguagaauuuaaagacgcacaugcaaaaagacaaacgguaguuguauuagguagucaagaaggagcaguacauacagcacuagcuggugcauuagaagcagaaauggacggagcaaaaggaagauuaagcagcggacaucuaaagugcagacuaaaaauggauaaacuucgccuaaaaggaguaucauacucauuauguacugccgcuuuuacauucaccaaaauaccugcugaaacuuuacacggaacagucacuguagaaguacaauaugcagguacagaugguccauguaaagugcccgcucaaauggcaguagauaugcaaacacuaacaccuguaggaagauuaauaacagcaaacccuguaauaacagaaucaacagaaaacucgaaaaugaugcucgaacuagacccaccguuuggagauaguuacauuguaauugguguaggagaaaaaaaaauuacacaucauuggcaccguucagggaguacuauaggaaaagcauuugaagcaacuguaagaggagcaaaaagaauggcaguauuaggugauacagccugggacuucgguaguguaggaggagcauugaacucccuaggaaaaggcauucaucaaauauuuggagcagcauuuaaaaguuuauuuggaggaaugucaugguuuagucaaauauuaauaggcacgcuacuuaugugguuaggacuaaauacaaaaaacggaaguauuagccuaaugugcuuagcuuuagggggcguguuaauuuuuuugagcacagcaguuagcgcagacguaggauguaguguugauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4710 - RNA, 2317 nt, Artificial Sequence
  ZIKV prME variant mRNA Design 1 opt
gggagaaagcuuaccauggacacuaguguaggaauaguaggucuacuacuaacaacagcaauggcagcagaaguuacucgaagagguagcgcauauuauauguauuuagauagaaaugacgcaggagaagcuauaaguuucccaacaacacuaggaaugaacaaauguuacauucaaauaauggaccugggacauaugugcgaugcaaccaugucuuacgaauguccuaugcuugacgaaggaguagaaccugaugauguugacuguugguguaauacaaccagcacuuggguaguauauggaacaugucaucauaaaaaaggggaagcaagacgaucaagaagggcagugacauugccaagucacucaacuagaaaauuacaaacuagaucacaaacaugguuggaaucaagagaauacacaaaacauuuaauuagaguggaaaauuggauauuccgaaacccaggauucgcauuagcggcagcagcaauagcuugguuauugggaagcucaacgagucaaaagguuauauaccuagugaugauacuauuaauagcuccagcauauuccauaagaugcauaggaguaaguaaccgagacuuuguagaaggaaugaguggaggaacauggguagauauaguauuggaacauggaggauguguaacaguaauggcacaagauaaaccaacaguagauauagaacuaguuacaacaacaguuucaaauauggccgaaguaagaucguacuguuaugaggcuagcauaucagacauggcaucugauucaagauguccaacucaaggcgaagcauacuuagauaaacagagugacacgcaauauguaugcaaaagaacacucguggauagaggaugggguaacggguguggccuguucggcaaagguagucuaguaacaugugcuaaauuugcuuguucaaaaaaaaugacaggaaaaucaauacaaccggaaaaccuagaauacagaauaauguuaaguguccacgggagucaacauucaggaaugauuguuaaugauacaggucaugagacugaugaaaauagagcaaaaguagagaucacaccaaauucaccacgagcagaagcaacacuaggugguuuuggaaguuuaggauuagauugugaaccaagaacaggauuagauuuuucagacuuguauuacuuaacaaugaauaauaaacacugguuaguccacaaagaaugguuucaugauauuccacugccauggcaugcaggagcagauacaggcacaccacacuggaauaacaaagaagcauuaguugaauuuaaagaugcacacgcuaaaagacaaacaguagucguauuaggaagucaagaaggagccguucacacagcacuagcaggugcauuagaagcugaaauggacggagcuaaagguagauuaucaaguggacaccuaaaaugcagacugaaaauggacaaauuaagacuaaaaggaguaaguuauagcuuauguacagcggcauuuacauuuacaaaaauaccggcagaaacauuacaugguacaguaacuguagaaguacaauacgccggaacagauggaccaugcaaaguaccugcucaaauggccgucgauaugcaaacccuaacaccgguuggaagacucauaacagcaaauccaguaauaacagagucaacagaaaauaguaaaaugauguuagaauuagacccaccauuuggugacucguacauagugauaggaguuggugaaaaaaaaauaacacaccauuggcacagaaguggaagcacuauuggaaaagcauuugaagcaacuguuagaggcgcaaaaagaauggcaguucuuggagauacagcaugggauuuuggaaguguuggaggagcauuaaacaguuuaggaaaaggcauacaucaaauuuuuggagcagcuuuuaaaucacuauuuggaggaaugucaugguuuucacaaauauuaauugguacuuuacuaaugugguuaggacuaaauacuaaaaaugguaguauaaguuuaaugugucuagcauuaggcggagucuuaaucuucuuaucaacagcaguaagcgcagacguaggguguaguguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4711 - RNA, 2314 nt, Artificial Sequence
  ZIKV prME variant mRNA Design 1 opt
gggagaaagcuuaccaugaccagcguuggaauaguagguuuacuauuaacaaccgcaauggcagcagaagugacaagaagaggaagugcauacuauauguacuuagaucguaacgaugcaggugaagcuauaucuuuuccaacaacguuaggaaugaauaaauguuacauacaaauaauggacuuaggacauaugugugacgcaacuaugucauaugaauguccaauguuagaugaaggaguugaaccagacgacguagauuguugguguaauacuaccaguacauggguaguauauggaacaugccaucauaaaaaaggagaggcuagaagaaguaggagagcaguaacauuaccaucucauucaacaagaaaacuucaaacacgaucacaaaccuggcuagaaagccgagaauacacaaaacaucuaauacgaguggaaaauuggauauuuagaaauccaggauucgcacuagcugcagccgcuaucgcauggcuacuagguaguucaacaucacaaaaaguaauuuacuuaguaaugauccuacucauugccccggcauauucaauaagaugcaucgggguuagcaacagagacuuuguugaaggcaugucgggaggcacauggguagauauuguacuugagcacggagggugcguaacuguuauggcucaagauaaaccaacaguugacauagaacuaguaacaacaacaguaucaaacauggcggaaguaagaaguuauugcuaugaagcaagcauaucugacauggcaucagauucuagauguccaacacaaggagaagcuuauuuagauaaacaaucagacacacaauacguauguaaaagaacauuaguagacagaggcuggggaaauggauguggauuguuuggaaaaggaucauugguaacaugugccaaauucgcauguaguaaaaaaaugacuggaaaaaguauccaaccagaaaauuuagaauaucgaauuauguuaagcguccaugguucccaacauucagguaugauaguaaacgauacaggacacgagacugaugaaaauagagcaaaaguggaaauaacuccaaauaguccaagagcagaagcaacuuuaggugguuuuggaucccucggauuggauugugaaccaagaaccggauuagacuucagugaucuauacuacuuaacaaugaauaauaaacacuggcuuguccacaaagaaugguuccacgacaucccauuaccauggcacgcaggcgcagauacaggcaccccacauuggaauaauaaagaagcacuaguagaauucaaagacgcacaugcaaaaagacaaacgguaguaguauuaggaagucaagaaggagcuguacauacagcccuagcuggagcacuagaagcagaaauggacggagcaaaagguagauuaaguaguggacaccugaaaugcagauuaaaaauggauaaacuaagguuaaaaggaguuagcuauucuuuauguacugcagcauuuacauucacuaaaauaccagcagaaaccuuacauggaacagugacaguagaaguacaauaugcaggaacugauggaccauguaaaguaccagcacaaauggcaguugauaugcaaacauuaacuccaguagggagacuuauaacagcaaauccaguaauaaccgaaucaacagaaaauagcaaaaugauguuagaauuagacccaccuuucggcgacagcuacauagucauaggaguuggugaaaaaaaaauaacccaucauuggcauagaaguggaagcacaauaggcaaagcauuugaagcaacugucagaggggccaaaagaauggcaguucuaggagauaccgcaugggacuucggaaguguaggaggagcacuaaacaguuuaggaaaaggaauacaucagauauuuggggcagcauucaaaagucuauuugggggcaugagcugguuuucacaaauuuuaauuggaacauuguuaauguggcuaggauuaaauacaaaaaaugguagcauaagcuuaaugugucuagcucuaggaggaguacugauuuuuuuaagcacagcuguuagugcugauguaggguguucuguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4712 - RNA, 2314 nt, Artificial Sequence
  ZIKV prME variant mRNA Design 1 opt
gggagaaagcuuaccaugacaaguguugguauagugggguuauuauuaacgacugcaauggcagcagcaguaacaagaagaggaucagcuuauuauauguauuuagacagaaaugaugcaggggaagcaaucucauuucccaccacucuagguaugaauaaauguuauauucaaauaauggaucucggucauaugugugaugcuacuaugaguuaugaauguccaauguuagaugaaggaguugaaccagaugaugucgacuguuggugcaauacaacaaguacuuggguaguauauggaaccugucaucauaagaaaggagaagcuagacguaguaggagagcaguaacacuuccaagucauucaacaagaaaacuacaaacuagaagccaaacaugguuagaaaguagagaauauacaaaacaccuaauaagaguagaaaacuggauuuuuagaaacccaggauuugcccuggcagcugcugcuauagccugguuacugggauccaguacaucacaaaaaguaauauacuuaguaaugauauuauugauagcucccgcuuauagcauaagauguauuggcgucucuaauagagauuucguagaagggaugaguggugggacauggguagauauaguauuagaacacggagguugcguaacaguaauggcacaagacaaaccaacaguagauauagaauuagugacaacaacagugagcaauauggcugaaguacgaucauauugcuaugaagcaucaaucucagauauggcuucagacucaagauguccaacgcaaggagaagcauaucuagacaaacaaagugauacacaauacguauguaaaagaacauuaguagauagagguugggguaaugguuguggacuauuuggaaaaggcuccuuaguuacaugugcuaaauucgcuugcuccaagaaaaugacaggaaaaucaauacaaccugaaaaucuugaauacagaauaaugcuaaguguacauggaagccaacauagugggaugauaguaaaugauacgggacaugaaacugaugaaaauagagcaaaaguagaaauaacuccaaauagcccaagagcagaagcaacuuuaggcggauucggcagccuuggauuagauugugaaccaagaacaggcuuagauuuuagcgacuuauauuacuuaacaaugaauaacaaacauugguuaguccauaaagaaugguuucacgauauaccauuaccauggcaugcgggugcugauaccgguacaccacauuggaauaacaaagaagcauugguagaguucaaagacgcacacgcaaaaaggcaaacagucguagucuugggaagccaagaaggagccguacauaccgcauuagcaggagcacuagaagcagaaauggacggagcaaaaggaagauuaagcaguggacauuuaaaaugucgauuaaaaauggauaaacuuagauuaaaaggagucucauauucacuuuguacagcagcauuuacuuuuacaaaaauaccugcagaaacauuacaugggacagugacaguggaaguacaauaugcaggaacagauggaccauguaaaguaccagcucaaauggcuguugauaugcaaacacuaacaccaguaggacgacuaauaacugcuaauccaguaauaacagaaucaacugaaaauagcaaaaugaugcuagaacuugacccgccuuuuggugacaguuauauaguuauaggugucggugaaaagaaaaucacacaucacuggcauaggagugggucaacaauagggaaagcguuugaagcaacagucaggggugcaaaaagaauggcuguacuaggagauacagcaugggauuuuggaaguguaggaggggcauugaauagucuaggaaaagguauacaucaaauauuuggggcagcauuuaaaagucuauuuggcggaaugucaugguuuucacaaauucuaauaggaacuuuacuuauguggcucggauugaauacgaaaaauggaucaaucagcuuaauguguuuagcuuuaggaggugugcuaauauuuuuaaguacagccguaucagccgauguaggauguucuguagauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4713 - RNA, 2326 nt, Artificial Sequence
  ZIKV prME variant mRNA Design 1 opt
gggagaaagcuuaccaugagaggagcagauacaaguguugggauaguaggacugcuucuaacuacugcaauggccgcugcgguaacgagacgaggaagugcauauuacauguauuuagacagaaacgaugcaggagaagcuauaaguuuuccaacaacgcuagguaugaacaaaugcuacauacagauaauggaucuaggacacaugugugacgcaacuaugucauacgaaugcccaauguuagaugaagguguagaaccagaugaugucgacuguuggugcaacacaacuucgacauggguaguauauggaacaugucaucauaaaaaaggagaagcacgccgaucaagaagggcagucacauuaccaucacacaguacaaggaaauuacaaacaagaagucaaacauggcuugaaucaagagaauauacaaaacacuuaauuaggguagaaaauuggauuuucagaaauccaggauuugcauuagcagccgcagcaauagcuugguuauuaggaaguaguacaagccaaaaaguaauuuauuuaguuaugauacuuuuaauagcuccagcauauucaauacgauguauagguguaucaaacagagauuuuguugaaggaaugaguggaggaacauggguagauauaguucuagaacauggagguuguguaacaguaauggcacaggacaaaccaacaguagacauagaauuaguaacaacaacaguuucaaauauggcagaaguaagaucuuauuguuacgaagcaaguauaagcgauauggcuagcgauucacgaugucccacacaaggagaagcuuaucuagauaaacaaucagauacacaauacguauguaaacgaacauugguagacagaggauggggaaauggauguggauuauuuggaaaagguagccuaguaacaugcgcaaaauucgccuguaguaaaaaaaugacaggaaaaucaauucaaccagaaaacuuagaauauagaauaaugcuauccguucacggcucgcaacauucagggaugauuguaaaugauacaggacaugaaacagaugaaaacagggcuaagguagaaauaacucccaauucaccaagagcugaagcaacauuaggcggguuuggaucacucggucuagacugugaaccacgaacuggauuagauuuuucagaucucuacuaucugacuaugaauaauaaacauugguuaguccauaaagaaugguuucacgauauaccacuacccuggcaugcaggugcagauacuggaacaccucacuggaauaauaaagaagcucuuguagaguuuaaagaugcacaugcaaaaagacaaacaguaguaguauuaggaagucaagaaggagcaguacacacagcauuagccggugcucuagaagcagaaauggacggagcaaaaggcagacucucaaguggacauuuaaaaugucgauuaaaaauggacaaauuaagguuaaaagguguaaguuacagucuauguacagcugcauuuacauuuacaaaaauaccugcugaaacgcuccauggaacagucacaguugaaguccaauaugccggaaccgauggcccauguaaagucccugcacaaauggcgguagacaugcaaacauuaacaccaguugguagauuaauaaccgcaaauccgguuauaacagaaaguacagaaaauuccaaaaugauguuagaauuagauccaccauuuggagacuccuauauaguaauuggaguaggagaaaaaaaaauaacacaucauuggcacagaucagguucaacaauaggaaaagcguucgaagcgacagugagaggagcaaaaagaauggcuguauuaggagauacagcuugggacuuuggguccguaggcggugcacuuaauucacuuggaaaaggcauacaucaaauuuucggggcggcuuuuaaaucacuuuucggaggaaugucaugguuuucacagauauuaauaggaacauuauuaaugugguuaggacuuaauacaaaaaauggaagcauuaguuuaaugugccuagcgcugggagguguacuuauauuucuuucaaccgcaguaagugcugauguaggguguucuguagacuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4714 - RNA, 2350 nt, Artificial Sequence
  ZIKV prME variant mRNA Design 1 opt
gggagaaagcuuaccaugagaggacugucaucgagaaaaagaagaagccaugauguccuaacaguucaauuucuaauauuagggauguuacuaaugacgggaggaguaacuagacguggaucagcauauuauauguaccuagauagaaacgaugcuggugaagcaauaucauuuccaacaaccuuaggaaugaauaaauguuacauucaaauuauggauuugggucauaugugcgaugcaaccauguccuaugaauguccaauguuagacgaaggaguggaaccagaugauguagauuguuggugcaauacaacgucaacuuggguaguauauggaacuugucaucauaagaaaggagaagcaagaagaucuagacgagcaguaacauuaccaucacauucaacuagaaaacuacaaacaagaagccaaacaugguuagagaguagagaauacaccaaacaucuaauaaggguugaaaauuggauauuucguaauccugguuucgcauuagcagcagcagcuauagcaugguuauuaggaagcaguacaucacaaaaaguaauauacuuagucaugauauuacuaaucgcaccagccuauucaauaagauguauaggaguuaguaauagagauuuuguggaagguaugagugguggaacauggguugacaucguacuagaacauggaggguguguuacuguaauggcacaagauaaaccgacaguugauaucgaauuagugacaacaacaguaucuaauauggcagaaguaagaagcuauuguuaugaagcuagcauauccgauauggcaucagacagcagaugucccacacagggagaagcauaucuugauaaacagucagacacacaguauguaugcaaaagaacauuaguagacagaggguggggaaacggaugugguuuauuuggaaaaggaucauuaguaaccugugcuaaauuugcaugcagcaagaaaaugacuggcaaaaguauacaaccggaaaaucuagaauaccgaauaaugcucaguguucacggaucacaacauucagguaugauuguaaacgauacuggacaugaaacagaugaaaacagagcaaaagucgaaauaacuccaaacaguccacgagcagaagcuacuuuaggcgguuuuggaucccuuggauuagauugugagccacgaacuggauuagauuucagugauuuauauuauuuaacaaugaauaauaaacacugguuaguacacaaagaaugguuccaugauauaccauuaccuuggcaugcaggagcugauacagggacaccacacuggaauaacaaagaagcccuaguagaauuuaaagaugcacaugcgaaacgacaaacaguuguugucuuaggaucucaagaaggugcaguacauacagcauuagcaggagcccuagaagcagaaauggacggugcuaaagggcgauuaucuagcggacauuuaaaauguagauuaaaaauggauaaauuaagacuaaaagguguuagcuauaguuuauguacagccgcauucacauucacuaaaauaccugcagagacucuacauggaacaguaacuguagaaguacaauaugcagguacugacggaccuugcaaaguuccagcacaaauggcaguugacaugcaaacacuaacuccaguaggaagauuaauaacggcgaacccaguuauaacagaaucaacugaaaauagcaaaaugaugcuugaacuagauccaccauuuggagacucauauauaguaauaggaguaggcgaaaagaaaauaacacaucacuggcauagaagugguagcacuauugguaaagcauuugaagcaacuguaagaggugcaaaaagaauggcaguauugggagauacugcaugggauuuuggaucaguaggcggggcacuaaauucacuugggaaaggaauacaucaaauauuuggagcagcauuuaaaucuuuauuuggaggcaugucaugguucucacaaauauugauuggaacccuacuuauguggcuagguuuaaacacuaaaaauggaucaauuucauugaugugcuuagcauugggaggaguauuaauauucuuaagcacagcaguaagugcagacguaggaugcaguguugacuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4715 - RNA, 2350 nt, Artificial Sequence
  ZIKV prME variant mRNA Design 1 opt
gggagaaagcuuaccaugagaggauuaaguagcagaaaaagaagaagccaugacguguuaacaguacaauuucugauacugggaaugcuacuaaugacuggagcaguaacuagaagaggaagcgcauauuauauguacuuagauagaaaugaugcuggugaagcuauauccuuuccaaccacauugggaaugaauaaauguuauauacaaauuauggacuuaggacauaugugugaugcuacaaugucauaugaguguccuaugcuagaugaaggaguagaaccagaugacguagauuguugguguaauacaacgucaacauggguaguauauggaacuugucaucauaagaaaggagaagcaagaagaucaaggagagcugugacacuaccuucacauagcacaagaaaacuucaaaccagaagccaaacauggcucgaaucaagagaauauacuaaacaucuaauacguguugaaaauuggauauuuagaaacccaggauucgcacuugccgcagcagcaauagcaugguuauuggguucgaguacaucucagaaaguaauauacuuaguaaugauucuauuaaucgcaccagcauauucaauaagaugcauaggagugagcaaccgagauuuuguugaaggcaugaguggaggaacguggguugauauaguucuggaacacggaggauguguuacaguaauggcacaagacaaaccaacaguagacauagaauuggucaccacaacaguaaguaauauggcagaaguaagaagcuacuguuacgaggccaguauuagugauauggcaucagauuccagauguccuacacaaggagaagcauauuuagacaaacaaucagauacacaauauguauguaaaaggacauuaguugacagaggauggggaaauggaugcggauuauuugguaaaggaucauuagugacaugugcuaaauuugcaugcaguaagaaaaugacaggaaaaagcauacaaccggaaaaucuugaguauaggauaauguuaaguguacacggaucacaacauucuggaaugauuguaaaugauacuggacaugaaacagaugaaaaucgagcaaaaguagaaauaacucccaauucaccaagagcugaggcaacacuaggaggauuugggagcuuaggauuagauugugaaccuaggacuggacuugauuuuagugaucuauauuauuuaacgaugaauaauaaacauuggcuaguacauaaagaaugguuucaugacaucccauuaccauggcaugccggggcagauacaggaacaccacacuggaauaacaaagaagcguugguagaauuuaaagaugcacaugcaaaaagacaaacaguuguaguauuaggaagccaagagggagcaguacauacugcacuugcaggagcauuagaagcagaaauggauggugcaaaaggaagacuaucaucagggcauuuaaaauguagacuuaaaauggauaaauuaagacuaaaaggcguaagcuauucauuauguacagcagcauuuacuuucacaaaaauaccagcagaaacauuacauggaacaguaacaguggaaguacaauaugcgggaacagauggaccauguaaaguuccagcacaaauggcaguugauaugcaaacauuaacaccaguuggaagacuaauaacagcaaauccaguaauaacugaauccacagaaaacucaaaaaugaugcuugaacuagauccaccauuuggagauaguuauauagugauuggcguuggggagaagaaaauaacacaucauuggcauagaucaggaucaacaauaggaaaagcauuugaagcaacuguaagaggagcaaaaagaauggcaguucuaggagauacagcaugggauuuuggaagcguuggaggagcgcuaaauagcuuggggaaagggauucaccaaauauuuggagcugcauuuaaaucauuauuuggaggaaugaguugguuuagccaaauacuaauaggaaccuuauugaugugguuaggauuaaauacuaaaaacggaaguauaaguuuaaugugucuagcacuagggggaguuuuaauauuuuuaaguacagcaguaucagccgauguaggcuguaguguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4716 - RNA, 2341 nt, Artificial Sequence
  ZIKV prME variant mRNA Design 1 opt
gggagaaagcuuaccaugagaauuauaaaugcaaggaaagagaaaaaaagaagaggugcagauacaagcguugguauaguaggacuacuauuaacaacugcaauggcggcagaaguaacaagacgugguucagcuuauuacauguauuuagauagaaacgaugcuggagaggcaauaucauuuccuacaacuuuaggaaugaauaaaugcuauauacaaauaauggauuuaggacauaugugugacgcaacaaugaguuaugaaugcccuaugcuagaugaaggaguugaacccgacgauguagauuguuggugcaauacuacaaguacauggguuguauauggaacaugucaucacaaaaaaggagaggcuagaagaucaagaagagcaguaacauuaccuucacacagcacacgaaaacuacaaacaagaucacaaacaugguuagaaucaagagaauacacaaaacaucuaauuaggguagaaaauuggaucuuuagaaauccuggcuuugcacuugcagcagcagcaauagcuugguuauuagguagcaguacaucucaaaaaguaauauauuuaguaaugauacuacuaaucgcaccagcauacagcauaaggugcauaggaguaucuaauagggauuuuguagaaggaaugucaggaggaacauggguugacauuguacuagaacauggugguuguguaacaguaauggcgcaagauaaaccaacagucgauauagaacuaguaacaacaaccguaucaaauauggcugaaguuagaucauauuguuaugaagcaucaaucagcgauauggcaucagacagcagaugcccaacucaaggagaagcuuauuuagauaagcaaucagauacucaauacguauguaaaagaacacuagucgauagaggaugggguaacggaugugguuuauucggcaaaggaucauuaguuaccugugccaaauuugcauguucaaaaaaaaugacuggaaaaagcauacaacccgagaauuuagaauauaggauaauguugucuguccauggaucucaacacucagguaugauaguuaaugauacaggacacgaaacagaugaaaauagggcuaaaguagaaauaacacccaauaguccucgagcugaagcaacacucggaggauuuggaagucuaggacuagacugugaaccaagaacaggacuagacuuuagugaucuauauuauuuaacaaugaacaacaaacauuggcuaguacauaaagaaugguuucacgacauaccucuaccuuggcacgcaggcgcugauacaggaacaccacacuggaacaauaaagaagcacuaguugaauuuaaagaugcucacgcaaaaagacaaacagucgucguacuaggaagucaagaaggagcuguacauaccgcgcuagccggcgcuuuagaagccgagauggacggagcaaaaggaagauuaucaucgggacacuuaaaauguagauuaaaaauggacaagcuaagauuaaaaggagucucauauucacuaugcacagcagcauuuacauucacaaaaauuccugcggaaacacuacauggaacaguaacuguugaaguacaauaugcaggaacagauggacccugcaagguuccugcacaaauggcuguagauaugcaaacacuaacaccaguaggaagacuaauaacagcaaacccaguaauaacagaaucuacagaaaauucaaaaaugauguuggaauuagauccaccauuuggggauaguuauauaguaauagguguaggagaaaaaaaaauaacacaucacuggcauagaaguggcuccacgauaggaaaagcauucgaagcaacaguacgaggagcaaaaagaauggcaguacuaggagacacagcaugggauuucggauccguuggaggagcauugaauucauuagguaaagguauccaccaaauauuuggagcggcauuuaaaucguuauucggaggaaugaguugguuuucucaaauccuaauugguacacuacucaugugguuagguuuaaacacaaaaaaugguucaaucucauuaaugugcuuagcgcuuggaggaguacuaauauuucucaguacagcugugagugcugacguagguuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4717 - RNA, 2338 nt, Artificial Sequence
  ZIKV prME variant mRNA Design 1 opt
gggagaaagcuuaccaugauuauuaaugcaagaaaagaaaagaaaagaagaggugccgauacaagcguaggaauaguaggacuacuacuuacaacagcaauggcagccgaaguaacaagacgcgguucugcuuauuauauguaucuagacagaaaugaugcuggagaagccauuaguuucccaacaacauuaggaaugaauaaauguuacauacaaauaauggaccuaggacacaugugugacgcaacaaugucauaugaaugcccaauguuagacgaagguguugaaccagacgauguagauuguugguguaauacaacaucaacauggguuguuuauggaacaugccaucauaagaaaggcgaggcuagaagaucaagacgagcagucacauuaccuagucauaguacaagaaaauuacaaacaagaucucagacauggcuugaaucaagagaauauacaaaacacuuaauuagaguugaaaauuggaucuuuagaaacccugguuuugcacuagccgcagcugcaauagcuuggcuauuaggaucaucuacaucacaaaaaguaauauauuuagucaugauucuacuaauagcaccagcauauucaaucagaugcauaggagugagcaauagagauuuuguggaaggcaugucuggagggacauggguagauauuguauuagaacauggagggugcguaacuguuauggcacaggauaaaccaacaguagacauagaauuaguuacaacaacaguuucaaauauggcggaaguuagaaguuacuguuaugaagcaucaauuucagauauggcaucagauaguagauguccaacacaaggggaggcuuauuuagauaaacaaagugacacucaauauguauguaaacgaacauuaguagauagaggauggggcaacgguugugguuuauuuggcaaaggaaguuuaguaacaugugcaaaauuugcguguaguaagaaaaugacaggcaaaucaauacaaccagaaaacuuagaauaucgaaucaugcuuaguguacacggcucacaacauucaggaaugauuguaaaugacacuggacaugagacagaugaaaacagagcaaaaguggaaauuacaccuaacucaccaagagcagaagcuacguuaggagguuucggaucucuuggauuagacugugaaccaagaacaggcuuagacuucucugaucuauauuaucuuacaaugaauaacaaacauugguuaguacauaaagagugguuucaugauauaccauuaccauggcacgcaggagcagauacagggacgccacauuggaacaauaaagaagcucuaguagaauuuaaagaugcacacgcaaaaagacaaacaguaguuguuuuagguucucaagaaggagccguacacacagcacuagcuggagccuuagaagcagaaauggacggggcuaaagguagauuaucaucuggacacuuaaaauguagauuaaaaauggauaaauuaagauuaaaaggaguaaguuauagccuguguacagccgcauuuacuuuuaccaaaauaccagcagaaacauuacaugguacaguaaccguagaagugcaguaugcaggaacagaugggccuuguaaagucccagcucaaauggcaguagauaugcaaacacuuaccccaguaggcagacuuauaacugcaaauccagugauaacagaaucaaccgagaacuccaaaaugaugcuagaacuagauccaccauucggagauaguuauauaguuaucggagucggagaaaagaaaauaacucaucauuggcauagaucagguagcacgauaggaaaagcauuugaagcaacagucagaggugccaaaagaauggcaguauugggagauacagcaugggacuuuggaagugucggaggagcacuaaauagcuuaggaaaaggaauacaucaaauuuucggagcagcauuuaaaucuuuauuuggaggaaugagcugguucucacaaauacuuauaggaacauugcugaugugguuaggacucaauaccaaaaacggaagcauaucauuaaugugucuagcacugggaggugucuuaauauuccuaucgacagcaguaucagcagaugugggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4718 - RNA, 2335 nt, Artificial Sequence
  ZIKV prME variant mRNA Design 1 opt
gggagaaagcuuaccaugaucaacgcaagaaaagaaaaaaaaagacgaggagcagacacaaguguaggaauaguaggauuacuuuugacaacugcaauggcagcggaaguaacaagaagaggaagugcauauuauauguauuuagaccgcaaugaugccggugaagcgauaucauucccaacuacuuuaggaaugaauaaauguuauauacaaauaauggauuuaggacauaugugugaugcaacgaugagcuaugaaugccccauguuagaugaaggaguagaaccagacgauguagacuguugguguaauacaacaaguacauggguaguauauggaacgugucaucacaaaaaaggagaagcaaggagaaguaggagagcaguaaccuuaccaucccauagcacucgaaaauuacaaacaagaagccaaacaugguuagaaagucgagaauauacaaaacauuuaauaagagucgaaaauuggauauuuagaaauccaggauucgcauuagcagcagcugcaauagcauggcuauuagguucaucaacaagucaaaaaguaauauauuuaguaaugauuuuacuaauagcaccagcauauucaauaagauguauuggaguaagcaaccgcgauuuuguagaaggaaugucaggaggaacauggguagacauaguacuagaacauggagggugugucacaguaauggcacaagauaaaccaacgguagauauagaauuaguaacgaccaccguuucuaacauggcugaaguacgaucauauugcuacgaagcaucaauaagcgacauggcaucagauucuagauguccaacucaaggagaagcguauuuggauaaacaauccgauacacaauacguaugcaagaggacucuaguagauagggguuggggaaacggauguggguuauuuggaaaaggaaguuuaguuacaugugcuaaguuugcguguaguaaaaaaaugacaggaaagucaauucaaccagaaaauuuggaauacagaauaauguuaagcguacauggcucacaacacagcggaaugauagugaaugacacaggacaugaaacagaugaaaauagagcaaaaguagaaauaacaccaaauaguccaagagcagaagcgacacuaggagguuuugguucauuaggucuagauugcgaaccucgaacagguuuagacuuuucagaucuguauuauuuaacaaugaacaauaaacauugguuaguccauaaagaaugguuucacgauauaccuuuaccguggcacgccggagcagacacaggaacaccccauuggaauaauaaagaagcacuaguagaguuuaaagacgcucaugcaaaaagacaaacuguaguaguuuuggguagccaagaaggagccguacauacagcauuagcaggagcgcuagaagcagagauggacggcgcuaaaggaagauuauccuccggacauuuaaaaugucgauuaaaaauggauaaauuaagacuaaaaggaguaucauauaguuuaugcaccgcagcuuuuacauuuacaaaaauaccugcagaaacucuacauggaaccguaacaguagaaguucaauaugcaggcacagauggaccauguaaaguuccugcacaaauggcuguagauaugcaaacacucacacccguuggaagauuaauaacagcgaacccaguaauaacugaaagcacagaaaauaguaaaaugauguuagaauuagacccaccauucggagauaguuauauaguaauagguguaggagaaaaaaaaauaacucaccauuggcacagaucagggucaacuauuggaaaagcauuugaggcaacaguaagaggagcgaaacguauggcaguauuaggagacaccgcgugggacuuugguagcguaggaggagcauuaaacucguuaggaaaaggaauccaucagauauucggagcagccuuuaaaagucucuucggaggaaugagcugguucucacaaauuuuaauaggaacauuacuaauguggcuaggauuaaauacaaaaaauggcaguauaucauuaaugugcuuagcucuaggaggaguacuaauauucuuaaguacugcagucucagcugaugugggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4719 - RNA, 2332 nt, Artificial Sequence
  ZIKV prME variant mRNA Design 1 opt
gggagaaagcuuaccaugaacgcaagaaaagaaaaaaaacgucguggugccgauacaaguguaggaauaguaggauuauuguuaacaacagcaauggcagcagaaguaacacgaagaggaucagcauauuacauguauuuggauagaaaugaugcgggagaagcaauaucauuuccaacuacacuuggaaugaauaaauguuauauucaaauuauggauuuaggacauaugugcgacgcuacaaugucauacgaaugcccgauguuagacgaagggguggaaccagaugacgucgauuguugguguaauacaacgucaacguggguaguauauggaacaugccaucacaaaaaaggcgaagcuagaagaagucguagagcaguaacauuaccaagccauaguacaagaaaauuacaaacacgaucccaaacuugguuagaaucaagggaauacacuaaacauuugauaagaguagaaaauuggauauuuagaaauccggguuucgcccuugcggcagcagcaauagcaugguuacuaggaucuucaacaagucaaaaaguaauauauuuaguaaugauacuuuuaauagcaccagcuuauagcauaagaugcauugguguaaguaauagggacuuuguagaagguaugucagguggaacauggguagauauaguacuagaacauggagguugcguaacaguuauggcacaagauaaaccaacggucgacauagaacuaguuacaacaacaguuagcaauauggcagaaguaagaucauauuguuacgaagcaucuauaagcgacauggcaagugauucuagauguccaacacaaggagaggcauaccuugauaaacaaagugauacucaauauguaugcaaaagaacauuaguagaucgaggauggggaaacggguguggucuauuugguaaaggaucauuaguaacgugugcaaaauuugcauguucgaaaaaaaugacaggaaaaucaauacaaccagaaaacuuagaauauagaauaaugcucagcguacaugguucacaacauucaggaaugauuguaaaugauacaggucaugaaacagaugaaaaccgagcaaaaguagaaauuacuccaaauaguccaagagcugaagcaacacuuggagguuuuggaagucuaggacuagacugcgaaccaagaacuggauuagauuuuucugaucuauacuaucuaacaaugaacaauaagcauugguuaguacauaaagagugguuucaugauauuccacuaccuuggcaugcaggugcugauacaggaaccccacauuggaauaauaaagaagcuuugguagaauuuaaagaugcacaugcaaaaagacaaacuguaguaguauuaggaucacaagaaggagcaguacacaccgcacuagcaggagcuuuagaagcugaaauggauggagccaaaggaagauuauccaguggacauuuaaaaugcagauuaaagauggacaaacuacgacuaaaaggaguaagcuauucauuauguacagcagcauuuacauuuaccaaaauaccugcugaaacucuacacggaacaguaacaguagaaguacaauaugcggguacagauggaccauguaaaguaccagcucaaauggcuguagauaugcagacuuuaacaccgguaggaagauugauaacugcaaauccuguaauaacugaaucaacagaaaauaguaaaaugauguuagaauuagauccaccauucggagauucauacauaguaauuggugucggggaaaaaaaaauaacccaucauuggcauagaucaggaaguacaauaggaaaagcuuuugaagcaacaguaagaggagcaaaaagaauggcggugcucggagauacagcuugggauuuuggcaguguagguggugcacuaaauucauuagguaaaggaauacaucaaauuuuuggagcugcguuuaaaucacuauucggaggaaugucuugguuuucucaaauauuaauugggacuuuguuaaugugguuaggucuaaauacaaaaaaugggucaauaucacuaauguguuuagcacugggaggaguauuaauuuuuuuaaguacagcaguaagcgcagacguaggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4720 - RNA, 2329 nt, Artificial Sequence
  ZIKV prME variant mRNA Design 1 opt
gggagaaagcuuaccauggccagaaaagaaaaaaaaagaagaggagcugauacaucaguaggaauaguaggacuauuguugacaacagcaauggcagcagagguaacaagacgagguagcgcauauuacauguauuuagauagaaacgaugcaggagaagcuauaucauucccaacuacauuaggaaugaacaaaugcuauauacaaauuauggauuuaggacauaugugugaugcaacaaugaguuaugaaugcccuauguuagaugaaggaguagaacccgacgauguugacugcuggugcaauacgacaaguacauggguuguauaugguacaugucaucauaaaaaaggagaagcaagacgaaguagacgcgcagucacauuaccgagccauagcacgcguaaacuacaaacacgaucacaaacuuggcuagagaguagagaauauacuaaacauuuaaucagagucgaaaacuggauauucaggaaucccggauuugcauuagcagcagcagcaaucgcauggcuauuaggcucaaguacuagucaaaaaguaauauauuuaguaaugauauuacuaauugccccagcauacaguauaagauguauagguguaagcaaccgagacuucguagaaggaaugucuggaggaacauggguugacauuguacuagaacacggagguugugucacagugauggcgcaagauaaaccuacaguugauauugaacuaguuacaacaacaguaaguaacauggcugaaguaagaucauacuguuaugaagcaucuauaagugauauggcuagugacagucgauguccaacacaaggcgaagcauacuuagauaaacaaucagauacucaauauguauguaaaagaacacuagucgacagaggguggggaaacggauguggacuauuuggaaaaggaucgcuagugacaugugcaaaauuugcaugcucaaaaaaaaugacaggcaaaucaauacaaccugaaaauuuagaauaccggaucauguuaucaguccaugguucacaacauagcggaaugauagucaaugauacaggacaugaaacggaugaaaacagggcaaaaguagaaauaacuccaaacaguccaagagcagaagccacauugggaggcuuuggaagcuuaggauuagacugcgaaccgcguacaggcuuagauuucuccgaucuuuauuaucuaacuaugaauaauaaacauugguugguacauaaagaaugguuucacgacaucccauuaccuuggcaugcaggagcagauacaggaacaccacauuggaacaauaaggaagcauuaguagaauucaaagacgcacaugcaaaaagacaaacaguaguaguacuaggaucacaagaaggagcaguccauacugcucucgcaggagcguuagaagcagaaauggacggagcaaaagggcguuugagcucaggacauuuaaaaugcagauuaaaaauggauaaauuacgauuaaaaggaguaucuuacucgcuauguaccgcagcuuucacauucacaaaaauaccagcagaaaccuuacaugggacaguaacgguugaagugcaauaugcagggacagauggcccauguaaaguacccgcucaaauggcaguugacaugcaaacucuaacaccaguaggaagauuaauuacagcaaacccaguaauuacagaaaguacugaaaacaguaaaaugauguuggaacuagauccaccauuuggagacagcuauauaguuaucggcguaggugaaaaaaaaauaacacaucauuggcauagaagugguaguacgauaggaaaagcuuucgaagcuacgguaagaggagcaaaaagaauggcagucuugggagauaccgcaugggauuuugguaguguugguggugcauuaaauucauuagguaaaggaauacaccaaauauuuggagcagcauucaaaucuuuauucggagguaugaguugguuuucacaaauauugauaggaacauuacuaauguggcuaggcuuaaauacaaaaaaugguuccauaaguuuaauguguuuagcauuaggggguguguuaauauuuuuaucuacugcaguuagugcugauguaggcuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4721 - RNA, 2326 nt, Artificial Sequence
  ZIKV prME variant mRNA Design 1 opt
gggagaaagcuuaccaugagaaaagaaaagaaaagaagaggugcagacacuucaguaggaauugugggauugcuacuuacaacugcaauggcagcagaaguaacacgacguggaucugcauacuauauguacuuagacaggaaugacgcuggugaagcaauaaguuuuccaacaacauuaggcaugaacaaaugcuacauacaaauaauggaccuaggacauaugugugacgcaaccaugaguuacgaauguccaauguuagaugaaggaguagagcccgaugauguagauugcugguguaauacaacaagcacauggguaguguauggaacaugucaccauaagaaaggugaagcaagaagaucaaggagagcaguaacucuuccaucacauucaacgcgaaaauuacaaacaaggucacaaacaugguuagaaaguagagaauauacgaaacaccucauaagaguagaaaauuggauauucagaaaucccggcuuugcacuagcagcagcagcaauagcaugguuacugggaaguaguacaucacagaaaguaauauauuugguaaugauauuacuuauagccccagcauauucaauuagauguauaggaguuucgaauagagauuucguggaaggcaugaguggaggaacguggguagacauaguuuuagaacauggaggaugugucacagugauggcacaagauaaaccgacaguagauauagaauuagugacaacuacaguaaguaauauggcagaaguuagaaguuauuguuaugaagcauccauaagcgauauggcuucagauucaagauguccgacucaaggagaagcauauuuagauaaacaaagugacacacaauacguauguaaaaggacucuaguagauagaggaugggguaauggauguggguuauuugguaaaggaucuuuagucacaugugcaaaauucgcaugcaguaagaaaaugacaggcaaaaguauccagccagaaaauuuggaauauaggauaaugcuaucaguacacgguucucaacauuccggaaugauugucaaugauacaggucaugaaacagaugaaaacagggcgaaaguggagauuacaccaaacucaccaagagcggaagcaacacuagguggauuugguucauugggauuagauugcgaaccaagaacaggauuagauuuuucagaucuguacuauuuaacuaugaacaacaaacauugguuaguacauaaagaaugguuucaugauauaccauuaccauggcaugcgggagcagauacaggaacgccacacuggaacaacaaagaagcacucguagaauuuaaagacgcacaugcgaaacgacaaacaguaguaguauuaggaagccaggaaggagcaguacauacagcacuagcaggcgcauuagaagcagaaauggauggagcaaaagguagauuaaguaguggacauuuaaaauguagguuaaaaauggauaaacuaagauuaaaaggaguaaguuauaguuuaugcacugccgcauucacauuuaccaaaauaccugcagagacauuacauggcacaguaacaguugaaguacaauacgcaggcacagaugggccaugcaaagugcccgcucaaauggcaguagauaugcaaaccuuaacgccaguuggcagauuaauaacugcaaacccaguuauaacugaaucgacagaaaacagcaaaaugauguuagaacuagauccgccuuuuggagauucauauauaguaauuggaguaggagaaaagaaaauaacacaucacuggcauagaaguggaagcacaauaggaaaagcauuugaagcgacaguaaggggagcgaaaagaauggccguauuaggagauacagcaugggacuucgguaguguaggaggagcuuuaaauagucuaggaaaaggaauacaucaaauauuuggagcagcuuuuaaaucacuauuuggugguaugucaugguuuucacaaauauuaauaggaacauuacuaauguggcuaggccuaaauaccaaaaauggaaguauaaguuuaauguguuuagcauuaggugguguauuaauauuucuaaguaccgcaguaucagcagauguuggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4722 - RNA, 2323 nt, Artificial Sequence
  ZIKV prME variant mRNA Design 1 opt
gggagaaagcuuaccaugaaagaaaagaaaagaagaggugcagauacauccguaggcauaguagguuuguuauuaacaacagcaauggcugccgaagugacuagacguggaagugcauacuacauguauuuagauagaaaugaugcuggagaagcuauuucauuuccuaccacauuaggaaugaauaaauguuacauacaaauaauggaucuaggucacaugugcgaugccacaaugagcuacgaauguccaauguuagaugagggaguagaaccagacgauguugauuguugguguaauacaacaucaacguggguaguuuaugguacaugccaucauaagaaaggagaagcuagaagaucaagacgagcaguaacauuaccaagucacucaacuagaaaacuacaaacaagaagccaaacauggcuagaaagcagagaauauacuaaacaccuuauuagaguagaaaauuggauauuuaggaacccaggauuugcuuuagcggcugcugcaauugcauggcugcuuggaucaaguacaucucagaaagucauauaucugguaaugaucuuauuaauagccccugcauacaguaucaggugcauaggaguaucgaaucgugauuucguagaaggaaugagcgggggaacauggguugacauaguauuagagcauggaggauguguuacaguaauggcacaagauaaaccaacugucgauauagaauuaguaaccaccacaguaagcaacauggcagaaguaagaaguuauuguuaugaagcaucaauaagcgauauggcaucugacucacgauguccaacacaaggggaagcauaucucgauaaacagucagauacucaauauguuuguaaaagaacucuaguagaucgaggcuggggaaacggaugcggucucuucggaaaaggaucauuaguaacaugugcaaaguucgcauguaguaagaaaaugacaggaaaauccauacaaccagaaaauuuagaauauagaauuauguuaagcguacaugguucucaacacucaggaaugauaguaaaugauacaggccaugaaacagacgaaaacagagccaaaguagagauaacaccaaacaguccacgagcugaagcuacauuaggaggguucggaucauuaggacuggauugugaacccagaacuggucuagacuuuucagaccuuuacuauuuaacaaugaauaauaaacauuggcuaguacacaaagaaugguuucacgacauuccguuaccauggcaugcgggugcagauacaggcacaccacauuggaauaauaaagaagcucuaguagaguuuaaagaugcacaugcaaaacgacaaacagucguaguacuagguagucaagaaggagcaguacauacugcauuagcuggagcauuagaagcagaaauggauggagcaaaaggaaggcuaucauccggucaucuaaaauguagacuaaaaauggauaaacugagauuaaagggagucagcuauucauuauguacagcagcauucacauucaccaaaaucccagcagagacuuuacauggaacaguaacagucgaaguacaauaugcagguacagauggaccauguaaaguuccagcacaaauggcuguagauaugcaaacguuaacacccguugguagacuaauaacagcuaacccaguuauuacagaaagcacagaaaauucaaaaaugauguuagagcuagacccaccauucggugauagcuauauugucauaggagucggagaaaagaaaauaacacaccauuggcacagaucaggaucaacaauaggaaaagccuuugaagcuacaguaagaggagcaaaacgaauggccguauuaggugauacagcaugggauuuuggaucaguuggaggagcacuuaacucucuagguaaaggaauacaucaaauauuuggagcagcuuucaaaucucuauuuggugguaugaguugguuuagucaaauauuaauugguacauuacuaaugugguuaggucuaaauacuaaaaaugguucaauaaguuuaauguguuuagcauuaggaggcguuuuaauauuuuuaaguacagcaguaagcgcugacguuggcuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4723 - RNA, 2320 nt, Artificial Sequence
  ZIKV prME variant mRNA Design 1 opt
gggagaaagcuuaccauggaaaagaaaagaagaggagcagauacaaguguaggaauuguuggacuauuauuaacuacagccauggcagcagaaguaacgagaagggguagugcuuauuacauguaucuagacaggaaugaugcaggggaagcaauaucuuucccaacuacauuaggcaugaauaaauguuauauucaaauaauggaucuaggacauaugugugaugcaacaaugucauaugaaugcccaauguuagaugaggguguggaacccgaugauguagauugcugguguaauacaacaagcacauggguuguauauggaaccugccaucauaagaaaggagaagcaagaagaucuaggagagcagugacguuaccaagucauuccacaagaaaauuacaaacaagaucgcagacaugguuagaaagcagagaauacacaaaacacuuaauaagaguagaaaauuggauuuucagaaauccagguuuugcauuagcagccgcagcaauagcauggcuccuaggaucaaguacaucucaaaaaguuauauauuuagucaugauacuacuaauugcuccugcauauaguauaagaugcauagguguuaguaauagagauuuuguagaagggaugucaggagguacauggguagauauaguauuagaacauggaggauguguaacuguaauggcacaagacaaaccuacaguagauauagaacucguaacuacaaccguaaguaauauggcagagguaagaucauauuguuacgaagcaucaauaucagauauggcaucagauaguagaugcccuacgcaaggagaagcauaucuagauaaacaaagcgauacucaauauguauguaaacgaacuuuaguagauagaggguggggaaauggauguggacuauuugguaaaggaucuuuaguaacuugugcaaaauuugcuuguucaaagaaaaugacuggaaaaucaauucaaccagaaaauuuagaauaucgaauaauguuaucaguacauggaucgcaacacagcggaaugauaguaaacgauaccggacacgaaacugacgaaaacagagcaaaaguagagauaacacccaauaguccaagagcagaagcuacacuaggaggauuuggcagccuuggacucgacugugagccaagaacgggauuagacuuuagcgaucuauauuacuuaacaaugaauaacaaacauugguuaguccauaaagaaugguuucaugacauuccacuaccauggcacgcuggugcagauacuggaacaccgcacuggaauaauaaagaagcccuaguugaauuuaaagaugcacaugcaaaaagacaaacagucguaguauuagguucucaggaaggagcaguucauacagcauuagccggugcauuagaagcagaaauggauggagcaaaaggaagauuaaguucuggacaucugaaaugucgacuaaaaauggacaaacuaagauuaaaaggaguaucauacucauuauguacagcagcauuuacauucacuaaaauaccagcagaaacauugcacgguacaguaacaguagaagugcaauaugcuggaacugauggcccguguaaaguaccggcacaaauggcuguagauaugcagacauuaacaccaguaggaagauuaauaacagcaaauccuguaauaacagaaagcacagaaaacaguaagaugauguuagaauuagacccacccuucggggacagcuauauaguuauaggaguuggagaaaagaaaauaacacaucacuggcauaggucaggaucaacaauagggaaagcauucgaagcgacuguuagaggagcaaaaagaauggcgguauugggagauacugcaugggauuucggaucaguaggaggagcauugaauagucuaggcaaagguauacaccaaauauucggggcagcauuuaaauccuuauuugguggaaugaguugguuuagucaaauuuuaauaggaacuuuacugaugugguuaggacuaaauacuaaaaauggauccaucucauuaaugugucucgcgcuaggaggaguacuaauuuucuuaucuacagcaguaucagcggacguaggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4724 - RNA, 2317 nt, Artificial Sequence
  ZIKV prME variant mRNA Design 1 opt
gggagaaagcuuaccaugaaaaaaagaaggggagcugauacaagcgucggaauaguaggacuauuauuaacaacagcaauggcagcagaaguaacacgaagaggcagcgcuuauuauauguauuuagauagaaaugaugcaggugaagccauaucauuuccaacaacucuaggaaugaauaaauguuacauacaaauaauggauuuaggacauaugugugaugcaacaaugaguuaugaaugcccaaugcuggaugaagguguugaaccugaugauguagauuguugguguaauacaacaucaacauggguaguauacggaacaugccaucacaagaaaggagaagcaagaagaucaagaagagcaguaacacuaccaagucacucuacaagaaaauuacaaacaagaagucaaacgugguuagaaucaagagaauauacaaaacacuugauacgaguagaaaacuggaucuuuagaaauccaggauucgcccuugcagccgcugcaauugcaugguuacuagguaguaguacuagucaaaaaguuauauaccuugucaugauauuauuaauagcuccagcauacucaauaagaugcauaggcguaaguaauagagauuuugucgaaggaauguccggaggaacauggguugacauaguauuagaacacggaggauguguaacaguaauggcacaagauaaaccaacuguugauauugaguuaguuacaacuacaguaucaaauauggcagagguacgaaguuauuguuacgaggcaaguauaucugauauggcaucugauucuagauguccaacucaaggagaagcauaucuugacaaacaaucugauacacaauaugucuguaaaagaacauuaguagaucguggaugggggaacggauguggauuauucggaaaaggaucacuaguaaccugugcuaaauuugcauguuccaaaaaaaugacugguaaaucaauccaaccagaaaauuuagaauacaggauaauguuaucaguccacgguagucaacauagcgguaugauaguuaaugauacaggacaugaaacagaugaaaaucgagcaaaaguugaaauaaccccaaauucaccaagagcagaagccacacuagggggcuuuggaucauugggauuagacugcgaaccucgaacaggauuggacuucucugauuuauauuaucuaacgaugaacaauaaacacugguuaguacacaaagaaugguuucacgauauaccucuaccauggcaugcaggugcagacacaggaacaccacauuggaacaauaaagaggcacuaguagaauucaaagaugcgcacgccaaacgacaaacagucguaguuuuagguucacaagaaggagcuguacauacagcuuuagcaggggcguuagaagcagaaauggauggugcgaaaggacguuugucaucuggucauuuaaaaugucgauugaaaauggauaaacuacgacuaaaaggaguaagcuacucacuuuguacugcggcuuuuacauuuacaaaaauaccagcagaaacccugcauggaacuguuacuguagaaguacaauaugcuggcacagacggaccuuguaaaguuccagcccaaauggcaguagauaugcaaacacuaacuccaguaggaagacuuauaacagcaaauccagugauuacagaaucaacagaaaauaguaaaaugauguuagaacucgauccaccauuuggagauagcuacauagucauaggaguaggcgaaaaaaaaauaacacaccauuggcauagaagcggaaguaccauaggaaaggccuuugaagcgacaguaagaggagcuaaacgaauggcaguacuaggggauacggcaugggacuuugguagcguaggaggagcauuaaacucucucggaaaaggaauacaccaaaucuuuggagcugcauuuaaaucauuauuugguggcaugaguugguuuagccaaauccuaauaggaacauuauuaaugugguuagguuuaaacacaaaaaauggauccauuucauugaugugucuggcacuuggaggaguauuaaucuuucuuuccacugcaguaagcgcagauguaggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4725 - RNA, 2314 nt, Artificial Sequence
  ZIKV prME variant mRNA Design 1 opt
gggagaaagcuuaccaugaagcgaagaggagcagauacuucaguaggaauaguaggacuauuauuaacaacagcaauggccgcagaagucacaagaagaggaucagcauacuauauguaccuagauagaaacgaugcuggagaagcaauaucguucccaacaacacuaggaaugaauaaauguuauauucagauaauggaucucggacauaugugcgaugcaacaaugucauaugaauguccaauguuagaugaaggagucgaaccugaugauguagauuguugguguaauacaacaucaacauggguaguauauggaacaugucaucacaaaaagggcgaggcuagaagaucccguagagccgucacauuaccaucgcauaguacaagaaagcuacaaacacguucucagacauggcuagaaaguagagaauauacaaaacauuuaauccgagucgaaaacuggauauuccgcaauccaggguuugcacuagcugccgcagcuauugcauggcugcuagguucaucaacgucacaaaaaguuauauaccuagugaugauauuauuaaucgcaccagcauauaguauuagauguauagguguaaguaauagagacuuuguagaagguaugagcggaggaacaugggucgauauaguauuagaacauggcggaugugugaccguaauggcacaagauaaacccacgguagauauagaauuggucacaacuacuguaucaaauauggcagaaguaagaucauacugcuacgaagcaucaaucucagauauggccucagauuccagauguccgacccaaggagaagcauaucuagacaaacaaucggauacacaauauguauguaaacgaacgcuaguugauagaggauggggaaauggauguggauuauuuggaaaaggaaguuuagucacaugugcaaaauucgcaugcagcaagaaaaugaccggaaaauccauacaaccagaaaaucuagaauauagaauaaugcuaucaguacacggaagccagcauaguggaaugauuguaaaugauaccggacaugaaacugacgaaaauagagcaaaaguagaaauaacaccaaauaguccaagagcagaagcaacauuagggggauucggaucacuagguuuagacugcgaaccacgaaccggauuagauuucagugacuuauacuauuuaacaaugaauaauaaacauugguuaguacacaaagaaugguuucaugacauaccauuaccauggcaugcaggagcagacacaggaacaccacacuggaacaauaaagaagcauuaguagaauuuaaagaugcacaugcaaaacggcaaacaguaguaguauuaggaagucaagaaggcgcuguacacacagcacuagcuggagcauuggaagcagaaauggacggagcaaaaggaagguuaucaaguggacacuuaaaauguagauuaaagauggauaaacuaagacuaaaaggaguaaguuauucauuaugcacagcugcuuuuacauuuacuaaaaucccagcagaaacacugcacgggacaguaacaguugaaguacaauaugcagguacugauggaccauguaaaguaccugcucaaauggcaguugauaugcaaacauuaacaccaguagggagauuaauuacugcaaacccaguaauaacagaaucuacugaaaauucaaaaaugauguuagaauuagauccaccguuuggagauaguuauauaguaauaggaguuggagagaaaaagauaacacaucauuggcacagaagcggaucaacuauaggaaaagcauuugaagccacaguaagaggagcaaaaagaauggcaguguuaggagauacagcaugggauuuuggaucagugggaggugcacuuaauucauuaggaaaagguauucaccaaauauucggagcagccuuuaaaagucuuuucggggguaugaguugguucagccaaauacuaauaggaacacuacuuaugugguuaggauuaaauacuaaaaaugguaguauaucuuuaauguguuuagcauuaggcggaguacugauauuuuuaucaacagcgguuagcgcugacguggguugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4726 - RNA, 2311 nt, Artificial Sequence
  ZIKV prME variant mRNA Design 1 opt
gggagaaagcuuaccaugaggcguggcgcagauacaucaguagggauuguaggauuauuauuaacaacagcaauggcagcagaaguuacaagaagaggaagugcauacuacauguauuuagauagaaacgaugccggagaagcaauauccuuuccaacaacauuaggaaugaauaaauguuauauacaaauaauggacuuaggacacaugugugacgcaacuaugucauaugaaugcccaaugcuagaugaaggagucgaaccugaugacguagauugcugguguaauacaacaaguacauggguaguauauggaacaugucaucauaagaaaggcgaagcaagacgaucaaggagagcaguuacacugcccucacacucaacaagaaaacuacaaacaagaucacaaacuugguuagaaucuagagaauauacaaaacaucuuauaagagucgaaaauuggauauuuagaaacccaggauuugcauuagccgcagcagcaauagcaugguuauuagggaguucaacaucacagaaaguuauauauuuaguaaugauauuauuaauugcaccagcauacucaauaagauguauaggaguuucgaauagggauuucguagaaggaaugucgggagguaccuggguagauauaguuuuagaacauggcgguuguguaacaguuauggcacaagauaaaccuacaguagauauagaacuuguaacaacaacaguuagcaacauggcugaaguaagaagcuauuguuacgaagcaucaauaucagacauggcauccgauucaagaugcccgacacaaggagaagcauaucuagauaaacaaucagauacacaauauguaugcaaacgaacucuaguagacagaggcuggggaaacgguugcggacuauucggaaaagguagccuaguaaccugugcuaaauucgcauguucaaagaaaaugacuggaaaaucaauucaaccugaaaacuuagaauauagaauuauguuaagcgugcauggaagccaacauucagguaugauugucaaugauacgggacaugaaacagaugaaaaccgugcaaaaguagaaauaacaccaaauuccccgagggcagaagcaacacuagggggauuuggaucacuaggcuuagauugugaaccuagaacuggauuagauuuuagugaucuauauuaccuaacaaugaacaauaaacauugguuaguucauaaagaaugguuucaugauauuccauuaccguggcacgccggugcagauacagguacgccacacuggaauaacaaagaagcauuaguagaauuuaaagaugcacaugcuaaacgucaaacugucguaguauuagguucacaagaaggagcaguacauacagcauuagcaggagcccuagaagcggaaauggauggagcaaaaggacgccuaucaaguggacacuuaaaaugucgcuuaaaaauggacaagcuaagauuaaaaggagucaguuauucucuaugcacagccgcuuucacauucacgaaaaucccugcggaaacacuucacggaacaguaacuguagaaguucaauacgcagguacagacggcccguguaaaguaccagcccaaauggccguagauaugcaaacauuaacaccaguaggaagacuaauaacugcaaauccaguuauaacagaaucgacagaaaacagcaaaaugauguuagaacuagacccaccauuuggagauucuuacaucguuaucggaguaggagaaaagaaaauuacacaccacuggcauagaaguggaucaacaauuggaaaagcauucgaagcaacgguaagaggagccaaacgaauggcaguuuuaggagacacugcaugggacuucggaagcguaggaggugcauuaaacucguuagggaaaggcauucaucagauauuuggagcagcauucaaaucauuauucggagguaugucaugguuuagucaaauacuaauuggaacuuuacuaaugugguuggguuuaaacacuaaaaacgguaguauaucacuuauguguuuagccuuaggcggaguguuaauauuuuuaucaacagcaguaagcgcugauguagguuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4727 - RNA, 2308 nt, Artificial Sequence
  ZIKV prME variant mRNA Design 1 opt
gggagaaagcuuaccaugagaggagcugauacaucaguaggaauuguagguuuauuacuaacaacagcaauggcagcagaaguuacaagaagaggaucagccuauuauauguauuuagaucgaaacgaugccggagaagcaauaaguuuuccaacaacuuuaggaaugaauaaaugcuauauacaaaucauggaucuuggacacaugugugacgcaacaauguccuacgaauguccaauguuagacgaaggaguagaaccugacgacgucgauuguugguguaauaccacaucaacauggguaguuuacgguacaugccaucauaagaaaggagaagcaaggcgaucaaggagagcaguaacauuacccucacauaguacaagaaaauuacagacuagaucacaaacauggcuugaaucgagagaauacacuaaacaccuaauaagaguagaaaacuggauuuuuagaaauccaggauuugccuuagcagcagcagcgauagcauggcuacuugggucuaguacaagucaaaaaguaauuuacuuaguaaugaucuuacuaauugcaccagcauacucaauaagaugcauuggaguaucaaauagagacuuugucgaagguaugagcgguggaacuuggguagacauugucuuggagcacgguggaugcguaacuguaauggcacaagacaaaccaacaguggacauagaauugguaacaacaaccguaaguaauauggcagaaguuagauccuauugcuacgaggcaucaauaagugacauggcaagugauucaagauguccaacacaaggagaggcuuaucucgauaaacaaagugauacccaauauguauguaaaagaacauuaguugacagagguuggggaaauggcuguggacuauucgguaaagggagcuuaguaacaugugcaaaauuugcauguucaaagaaaaugacaggaaaaucuauacaaccagaaaaucuagaauauaggauuauguuaagcguucauggaucgcaacauaguggaaugauugucaaugacacaggacaugaaacugacgaaaaccgagcuaaaguggaaauaacaccaaauucaccacgagcagaagcuacacucggaggcuucggaucacuaggauuggacugugaaccaagaacagguuuagauuucagcgaucuauauuauuuaacuaugaauaauaaacauugguuagugcauaaagaaugguuucaugauauaccauuaccuuggcacgcaggagcagauacaggcacaccacacuggaauaauaaagaagcccuaguagaauuuaaagaugcacacgcuaaaagacaaacaguaguuguacuaggaucacaagaaggugcuguacauacagcacuugccggggcauuagaagcagaaauggauggagcuaaaggaagauuaagcucaggucacuuaaaauguagauuaaaaauggauaaauuaaggcuaaaaggaguaagcuacucuuuauguaccgcagcuuucacauuuacaaaaauaccagcagaaacauuacauggaacaguaacuguagaaguacaauaugcagguacagaugguccauguaaaguaccagcacagauggcaguagauaugcaaacauuaacaccaguagggagauugauaacagcuaauccugucauaacagaaucaacugaaaauagcaaaaugaugcuagaacuagauccaccauucggugauucauauauaguaauaggaguuggagaaaagaaaauaacgcaucacuggcauagaagcgguaguacaauaggaaaagcauuugaggcaacaguaaggggcgcaaaaagaauggcuguauuaggagauacagcaugggauuucggaagcgucgguggagcacuaaauucacuaggaaaagguauucaucaaauauucggagcagcuuuuaaaucuuuguuuggaggaaugaguugguuuucucaaauacuaauuggaacauugcugaugugguuaggacuaaacacuaaaaacggaucaauuagcuuaaugugucuagcucucggagguguauugauauuuuuaucaacagcuguaucagcggacguuggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4728 - RNA, 2305 nt, Artificial Sequence
  ZIKV prME variant mRNA Design 1 opt
gggagaaagcuuaccaugggagcugauacaagugucggaauagucggacuauuacuaacuacagcuauggcagcggaaguuaccagaagaggcagcgcauauuauauguauuuagauagaaaugaugcaggagaagcaauauccuuuccuaccacucuaggaaugaauaaauguuauauacaaauaauggaccuaggacacaugugcgaugccacuaugaguuacgaaugcccuaugcuugaugaaggagucgaaccugaugauguagauugcugguguaauacaacaaguacauggguaguauacggaacaugccaucauaagaaaggagaggccagaagaucaaggagagcaguaacacuacccucucauucaacaagaaaauuacaaacaagaagccaaacaugguuggaaaguagagaauauacaaaacaucuaauucgaguagaaaauuggauauuuaggaacccaggauuugcacuagcagcagcagcaauugcuugguuacuaggaucaucaacaucacaaaaaguaauauaccuaguaaugauacuauuaauagcaccagcauauaguauaagauguauaggaguaucuaaccgagauuuuguugaaggaaugagcgggggaacauggguagauauaguguuagaacauggaggauguguuaccguaauggcacaagauaaacccacaguggacauagagcuaguuacaacuaccgucucaaauauggcagagguacgaagcuauugcuaugaagcgagcauaagugauauggcaagugauagccgauguccuacccaaggagaagcauaucuagauaaacaaucagacacucaauauguaugcaaacgaacauuaguugacagaggaugggggaauggauguggacuauuugggaaaggaucucuaguaacaugugcaaaauuugcuuguagcaagaaaaugacagguaaaucaauacaaccagaaaauuuagaguaucgaauuaugcuaagugugcauggaucacaacauucggguaugauaguaaaugacacuggacaugaaacugacgaaaauagagcgaaagucgaaauaacaccaaauuccccaagagcggaagcuacucuaggaggcuucggaagucuggguuuagauugugaaccuagaaccggacuagauuucucugauuuauauuauuuaacaaugaauaauaaacauugguuaguacauaaagagugguuucaugauauuccacuaccauggcaugcuggugcggauacaggaacuccacauuggaacaauaaagaagcauuaguugaauuuaaagacgcacaugcuaaacgacaaacagucguaguacuaggaagucaagaaggagcuguucacacagcucuagcaggagcauuagaagcagaaauggauggagcaaaaggaagauuaucaaguggacaucuaaaauguagauuaaaaauggacaaacuuagauuaaaaggaguaucuuauucucuauguacagcugccuuuacauuuacaaaaauaccugcugagacauuacacggaacaguuacaguugaaguucaauaugcaggcacugauggaccauguaaggucccagcucaaauggcaguagauaugcaaacauuaacaccaguuggaagauuaauaaccgcaaauccuguaauaacagaaagcacagaaaauucaaaaaugauguuagagcuagauccaccauuuggagacucauacauaguaauaggaguaggugaaaagaaaauuacacaucauuggcauagaucaggaaguacaauagguaaagcauuugaagcaacaguaagaggagcaaaaagaauggcaguccuuggcgauacugcaugggauuuuggaucaguuggaggagcacuaaacucucuaggcaagggaauacaucaaauauuuggagcagcuuucaaaaguuuauuuggaggaaugucaugguuuucucaaauacuaauaggaacauuacuuaugugguuaggacuaaauacuaaaaacggcaguauaucucuaauguguuuagcauuaggagguguuuuaauauuucuuucuacagccguaucggcagauguuggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4729 - RNA, 2302 nt, Artificial Sequence
  ZIKV prME variant mRNA Design 1 opt
gggagaaagcuuaccauggcugacacaucaguuggaauaguaggacuauuauuaacaaccgcaauggcagcagaaguaaccagaagaggaucagccuauuauauguaucucgauaggaacgacgcaggcgaagcaauaucauuuccuacaacacuagguaugaauaaauguuauauucaaauaauggaucugggacauaugugcgacgcaaccauguccuaugaauguccuauguuagaugaagguguagagccagaugauguugacuguugguguaauacaacuaguacuuggguaguauacggaacaugucaucauaaaaaaggagaggcccgaagaucaaggagagccguaaccuuaccaagucauucaacaagaaaauuacaaacuaggagucagacuuggcuagaaagucgagaauauaccaaacauuuaauacgaguagaaaauuggauuuuucgaaauccaggauuugcacuugcugcugcugcgauugccugguuacuuggaagcucaacaagucaaaaaguaauuuauuuaguuaugauauuauuaauagcaccagcuuacagcauuagauguauaggagugucaaauagagacuuuguagagggcaugaguggagguacguggguagauauaguauuagaacauggaggaugcgugacaguaauggcacaagacaaaccaacgguagauauagaauuaguaacaacuaccguaucgaauauggcagaaguacgaucauauugcuaugaagcaucaauaagugauauggcuuccgacagcagaugcccuacucaaggagaagcauacuuagauaagcaaagugauacccaauauguuugcaaacgcacacuaguagauagaggaugggguaauggaugugguuuauuuggcaaaggaagucugguaacaugugcuaaauuugcaugcucaaaaaaaaugacaggaaaaucaauacaacccgaaaauuuagaauauagaauaauguuaagugugcaugguucacaacauagcggaaugauuguaaaugauacuggacaugaaacagaugaaaauagagcaaaaguagaaauaacaccaaacaguccaagggcggaagccacacuagguggauuugguucauugggacuagacugugaaccgcgaacuggcuuagauuuuagcgauuuauauuauuuaacaaugaauaacaaacauugguuaguacacaaagaaugguuccaugacauuccacuuccauggcacgcuggcgcagauacuggaacaccucacuggaauaacaaagaagcacuaguggaauucaaggacgcacacgcaaaaagacaaacaguaguaguucuaggaucacaagaaggagcaguacauacagcuuuagcgggagcauuagaagcagaaauggauggagcaaaaggaagacuaucaagcggacaucuaaaauguagguuaaaaauggacaaacuaagauuaaaaggagugucauauaguuuauguacagcagcauucacuuuuacaaaaauuccagcugaaacauuacaugguacaguaacaguugaaguucaauaugcuggaacagauggaccauguaaaguaccagcacaaauggcaguagacaugcaaacacuaacacccguuggccggcuaaucacagcaaauccaguaauuacagaaucaacugaaaauucaaaaaugauguuagaauuagauccacccuuuggagauaguuacauaguaauaggcguaggagaaaaaaaaauuacacaucauuggcauagaucugggucaacaauuggaaaagcguuugaagcaacaguaaggggcgcuaaacguauggcaguucuaggagauacggcuugggauuucggcucaguaggaggagcacuaaauucauuaggaaaaggaauacaucaaauuuuuggagcagcauucaaaucauuauuuggaggaaugagcugguucucacaaauuuuaauaggcacauugcuaauguggcuaggauuaaauaccaaaaaugguucaauauccuuaauguguuuagcauuaggaggaguuuuaauauuuuuaaguacagcaguaucagcagacguuggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4730 - RNA, 2299 nt, Artificial Sequence
  ZIKV prME variant mRNA Design 1 opt
gggagaaagcuuaccauggauacaucaguugguauaguaggacuauuguuaacaacagcaauggcggcagaaguaacaagaagaggaucagcguacuacauguaucuagauagaaacgaugcaggugaagcaauaucauucccaacgacccuaggcaugaacaaauguuauauacaaaucauggaucuaggucauaugugugaugcaacaaugucuuaugaaugucccauguuagaugaaggcguagagccugaugacguagacuguugguguaauacaacaaguacauggguaguuuauggaacaugucaucauaaaaaaggagaagcaagaagaagcagacgagcugugacacuaccuucacacaguacaagaaaauuacaaacaagaucacaaaccugguuggaaagcagagaauauacaaaacacuuaauacgaguagagaacuggauuuuuagaaauccagguuucgcauuagcugcagcagcaauagcauggcuauuagguaguucaacaucucaaaaaguaauauauuugguaaugauauuacuaauagcuccagcuuauaguaucagauguaucggcguaucaaauagagacuuuguugaagguaugucaggaggaacaugggucgauauaguucuugaacaugguggauguguaacaguaauggcacaagacaaaccuacaguagauauagaauuaguaaccacaacaguaucaaacauggcugaaguaagaucuuauuguuaugaagcaagcauaucagauauggcaagcgacagcagaugcccaacacaaggagaagcuuaccuagacaaacaaagugauacucaguacguauguaaacggacacuuguggauagagguuggggaaacggauguggauuauuuggaaaaggcaguuuaguaacaugcgcaaaauuugccuguucaaaaaaaaugaccggaaaaucaauacagccagaaaaucuagaauaccguauaauguuaaguguacaugguagucaacauagugggaugaucguaaaugauacaggacaugaaacagacgaaaacagagcgaaaguagaaauuacaccuaauucaccaagagcagaagcaacauuagguggauuuggcucacuuggauuagauugcgaaccaagaacuggacuagauuuuucagauuuauacuauuuaacaaugaauaauaaacauugguuaguucacaaagaaugguuucaugauauaccucuaccuuggcacgcgggagcagacacaggaacaccucacuggaauaauaaagaagcuuuaguugaauuuaaagaugcucacgcaaaacgacaaacuguaguugucuuagguucucaagaaggagcaguacauacugcauuagcaggcgcucuagaggcagagauggauggagcaaaagguagauuaucgaguggacauuugaaaugcagauuaaaaauggacaaauuaagguuaaaaggaguaaguuacucauuauguacagcagcauuuacauuuacaaaaauaccagcagaaacauuacacggaacuguaaccguugaaguacaauaugcagguacagauggaccaugcaaaguaccagcacaaauggccguagacaugcagacauugacuccaguaggaagauuaauaacagcaaauccaguaauaacugaaagcacggaaaauaguaaaaugaugcucgaauuagauccaccauuuggagauaguuacaucguaaucggaguuggcgaaaaaaaaauuacacaccacuggcauagaucugguucaacaauaggaaaagcauucgaagcaacaguacgcggagccaaacgaauggcaguuuuaggagauacagccugggauuuuggcaguguaggaggcgcucucaauagucuuggaaaaggaauacaucaaaucuuuggagcagccuuuaagagucuguucggaggaaugaguugguucucacaaauacuaauagguacguuauuaauguggcuaggauuaaacacaaagaaugguucaauaucuuugaugugucuagcuuuaggaggcguacucaucuuuuugucaacagcaguaucagcugauguaggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4731 - RNA, 2296 nt, Artificial Sequence
  ZIKV prME variant mRNA Design 1 opt
gggagaaagcuuaccaugacaaguguaggaauuguaggauuacuacuaacaacagcuauggcagcagaaguaacaagaaggggcucagcauauuauauguauuuagauagaaacgaugcuggggaagcaauaagcuucccuacaacauuaggaaugaacaaauguuacauacaaauuauggacuuagggcauaugugugaugccacaaugucuuaugaaugcccaauguuagaugaaggaguagagccugacgauguagacuguugguguaauacaacaucaacuugggugguauauggcacaugucaucauaaaaaaggcgaagcacgaagauccaggagagcuguaacacuaccaucacauaguacaagaaaauuacaaacaaggucucaaacaugguuagaaucucgcgaauauaccaaacaccuuauaagaguagaaaauuggauauucagaaauccaggcuucgcacuagcagcugcagcuauagcaugguuauuaggaucguccacaucacaaaaagucauauauuuaguaaugauacuauuaaucgcaccagcauauucaauaagguguauaggagugucaaacagagauuuuguugaaggaauguccggaggaacauggguggacauaguucuugaacacggaggauguguuacaguuauggcucaagauaaaccaaccguugacauagaauuaguaacaacaacuguaaguaauauggcagaaguaagaaguuacuguuaugaagcaagcauaucagauauggcaucagacucaagaugcccaacacaaggugaagcauauuuggauaaacaaucagauacacaauauguauguaaaagaacacuaguagauagagguugggggaacggauguggauuauuuggaaaaggcagcuuaguaacaugugcaaaauuugcaugcagcaaaaaaaugacaggaaaaucuauacaaccagaaaaucuagaauacagaauaauguugucaguacaugggucacaacauucaggaaugauaguaaacgauaccgggcacgaaacagacgagaaccgagcgaaaguugaaauaacaccaaacagcccaagagcugaagcaacauuagggggauucggcucauuaggacuagauugcgagccaagaacaggauuagacuuuucagaucuguauuauuuaacaaugaacaauaaacauugguuaguucauaaagaaugguuucacgauauuccauuaccauggcaugcgggagcagauaccggaacaccacauuggaauaacaaagaagcuuuaguagaauucaaagacgcacaugcaaaaagacaaacaguuguaguauuagguagccaggaaggggccguacauacagcacuugcaggagcauuagaggcagaaauggauggugcuaaaggcagacuaaguaguggacaucuaaaauguaggcuaaaaauggauaaauugagacucaaaggagucucauauagucuauguaccgcagcauucacauuuacaaaaauaccugcagaaacacuucauggaacaguaacuguugaaguacaauacgcagggacugauggaccauguaaagucccagcacaaauggcaguagauaugcaaacauuaacaccuguugguagguuaauaacagcaaacccugugauaacugaaucuacagaaaacagcaaaaugauguuagaguuagacccaccauuuggagauaguuauauagucauaggaguaggcgaaaaaaaaauaacucaucauuggcacagaucaggcaguacgauagguaaagcauuugaggcaacaguacgcggagcgaaacgaauggcaguacuaggagauacagcaugggauuucggcucaguuggaggagcauuaaauucacuuggaaaaggcauacaccaaauauuuggugcagcauucaaaagccuauuuggaggaaugucaugguuuagucaaauauuaauaggaacauugcuaauguggcuuggauuaaauacaaaaaauggauccauaucacuaaugugccuagcauuaggaggaguauuaauauuccuaucuacggcagugagcgccgauguaggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4732 - RNA, 2296 nt, Artificial Sequence
  ZIKV prME variant mRNA Design 1 opt
gggagaaagcuuaccaugacuagcguaggaauagucggacuucuauugacaaccgcuauggcagcagcaguuacaagaagaggcuccgcauauuacauguaccuagacagaaaugaugccggagaagccauaagcuuuccaacaacacuaggaaugaauaaauguuacauucaaaucauggaucucggacauaugugugaugcaacaaugaguuaugaauguccaauguuagacgaaggaguagaaccugaugaugucgauugcuggugcaauacaacaucaacaugggucguauauggcacuugccaccauaaaaagggagaagcuaggcguucacgaagagcaguaacacuaccaucccauucaacuagaaaauuacaaacccgaagucaaacuugguuagaauccagagaauauacaaaacacuugauaagaguagaaaauuggauauuuagaaauccagguuucgccuuagcagcugcagcaauugcaugguuacuaggaagcucaacaucacaaaaaguuauauacuuaguaaugauacuauuaauagcuccagcuuacucaauaagauguauaggaguuucaaauagggauuucguagaagggaugucaggagguacaugggucgacauaguauuagaacauggaggaugcguaacaguuauggcucaagauaaaccaacggucgauaucgaacuuguuacaacuacaguaucuaauauggcagaaguaagaaguuauuguuaugaggcaucuauaagugauauggcuagugauaguagauguccaacacaaggugaagcauacuuagauaaacaaucugacacacaauauguuuguaaaagaacacuaguagaccgaggauggggcaacggguguggauuauuuggaaaaggaaguuuaguaacaugcgcaaaauuugcauguucaaaaaaaaugacaggaaaaucgauucaaccugaaaaucuagaauauagaaucaugcuuucaguucacggaucacagcauaguggaaugauaguaaaugauacaggucacgaaacggacgaaaauagagccaaaguagaaauaacuccgaauucaccaagagcggaagccacucuuggcggauuuggaucauuaggauuagauugugaaccaaggacaggacuagauuucucagaucuauauuaccuuacaaugaauaacaaacauugguuaguacacaaagaaugguuucaugauauaccacuaccuuggcacgcaggagcugauacugguacaccacacuggaacaacaaagaagcguuaguagaauuuaaagaugcacaugcaaaaagacaaaccguaguaguacucggaagccaagaaggagcaguacauacagcucuagcuggagcauuagaagcagaaauggacggagcaaaaggaagauuaucuaguggccaccuuaaauguagauuaaaaauggauaaguuaagacucaaagguguaucauacucauuauguacugcugcauuuacauucacgaaaauaccugcagaaacacuacauggaacuguaacuguugaaguccaauaugcagguacagauggaccauguaaaguaccagcacaaauggcugucgauaugcaaacguuaacuccuguaggacgauuaauaacagcaaauccaguuauaacggaauccacagaaaacucaaaaaugauguuagaauuagauccaccauuuggagauucauauauaguuaucgguguuggagaaaaaaaaauaacucaucauuggcauagaagugguucaaccauaggaaaagcauuugaggcaacuguaagaggagcaaaaagaauggcugugcugggagauacagcuugggauuuuggaagugugggcggagcauuaaauagcuuagguaaagguauacaucaaauauuuggagcagcauuuaaaucacuauuugguggaaugucaugguuuagucaaauacugauagguacucuuuugaugugguuaggauuaaauacaaaaaauggaagcauaaguuuaauguguuuagcauuaggaggaguauuaauauuucuaagcacagcaguaucagcugacguaggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4733 - RNA, 2308 nt, Artificial Sequence
  ZIKV prME variant mRNA Design 1 opt
gggagaaagcuuaccaugagaggagcagauaccaguguaggaauaguaggucuauuauuaacaacagcuauggcagcagccguaaccagaagaggaagugcauauuauauguaccuugacaggaaugaugcgggugaagcaauuaguuuuccaacaacacuugggaugaauaaauguuauauucaaauuauggaucuuggucauaugugugaugcaacaaugagcuacgaauguccuaugcucgaugaaggaguagaaccagaugauguagauuguugguguaauacaacgagcacuuggguaguauauggaaccugccaucauaagaaaggggaagcuagaagaaguaggagagcaguaacacugccaucacauucgacaagaaaacuacagacaagaagucaaacaugguuggaaaguagagaauacacaaaacauuuaauuagaguagaaaacuggauauuuagaaauccuggauucgcauuagcagcagccgccauagcuugguuguuaggaaguagcacaagucaaaaagugauauauuuaguuaugauauuacuaauagcuccugcauauaguauaagaugcauaggaguaaguaauagagacuuuguugaagguauguccgggggaacauggguagacauaguacuagaacauggaggauguguuacaguuauggcacaagauaaaccuacaguggauauugaacuuguaacuacaacggucucaaauauggcagaaguacgaucauauuguuacgaagcaaguauaucugauauggcaucugacucaagaugcccaacgcaaggagaagcauaccuugauaaacaaagugauacacaauacguaugcaaaagaacucuaguagacagaggauggggaaauggcuguggauuauucggcaaaggaucucuuguuacaugcgcaaaauuugccugcucgaagaaaaugacaggaaaaaguauucaaccagaaaauuuagaauauagaauaauguuaagugugcacgguucacaacauuccgguaugaucguaaacgauacaggacaugaaacagaugaaaauagagcuaaaguagagauuacaccaaauaguccacgagccgaagcaacacucggcggauuuggcaguuuagguuuagauugcgaaccgagaacagguuuagauuuuucagauuuauauuauuuaaccaugaacaauaaacauugguuaguccauaaagaaugguuucacgacauaccucuaccauggcaugcaggagcagauacagguaccccucauuggaauaauaaagaggcuuuaguagaauuuaaagaugcacacgcaaaaagacaaacagugguuguauuagguagccaagaaggugcaguacauacagcucuagcaggagcauuagaagcggaaauggauggugcaaaaggaagauuaaguucagggcacuuaaaauguagauuaaagauggacaaguuacgauuaaaaggaguaucauauagccuauguacagcggcauuuacauuuacuaaaauaccagcagaaacacuacacggaacaguaacaguugaaguacaauaugcuggaacagauggccccuguaaaguaccagcacaaauggcaguagacaugcaaacacuaaccccaguaggaagauuaauaacagcaaauccgguaauuacugaaucuacugaaaauagcaaaaugaugcuagaauuagauccaccauucggcgacagcuauauagucauaggggugggagaaaagaaaauuacacaucauuggcacagaucaggaaguacuaucgguaaagcauuugaagcaacaguaagaggagcuaaaagaauggcaguacuaggggauacagcaugggacuuuggaagugucgguggagcacuaaauucuuugggaaaagggauacaccaaauauuuggugcagcauuuaaaaguuuauucgguggaaugucuugguucagucagauacuaauuggcacucuuuuaaugugguuaggucuaaauacgaaaaaugggucaauaucucuaaugugucuagcauuaggagguguuuuaaucuucuuaagcacagcaguaucagcagacguaggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4734 - RNA, 2332 nt, Artificial Sequence
  ZIKV prME variant mRNA Design 1 opt
gggagaaagcuuaccaugcgaggacugucaucaagaaaaagaagaucacaugauguacuuacaguacaauucuuaauauuaggaauguuacuaaugacaggaggcguaacaagaagagguagcgccuacuauauguaucuagauagaaaugaugcaggagaagcaaucaguuucccuacaacccuugguaugaauaaaugcuauauacaaauaauggauuuggggcacaugugugacgcuacaaugaguuacgaauguccaauguuagaugaaggagucgaaccagaugauguagauugcugguguaacaccacaucaacaugggugguauacgggacaugccaucauaagaaaggagaagcaagacguucaagacgagcuguaacauuaccaagucauagcacaagaaaauuacaaacuagaucacaaacaugguuagaaucccgagaguacacaaaacaucuaauaagaguggaaaauuggauuuuuagaaauccagguuucgcauuagcugcagccgcuauagccugguuauuagguucaucuacaagucaaaaaguaauauauuuaguaaugauauuacuaauagcaccagcauauucuauaagauguauaggagucucaaauagagauuucguagaagguaugagcggaggaacuuggguagauauuguacuagaacaugguggcuguguaacaguaauggcucaagauaaaccuacaguagauauagaauuaguaacaacgacaguaucaaauauggcagaaguuagaucuuauuguuacgaagcaagcaucucagauauggcaagugacaguagaugcccaacacaaggggaagcauaucuagacaaacaaucagacacucaauauguauguaaaagaacuuuaguugaccgaggauggggaaaugguuguggacuauucgguaaaggaucauuaguuacuugugcgaaauucgccugcagcaagaaaaugacaggaaaaucaauccaaccagaaaacuuagaauacagaauaaugcuaaguguacauggaagccagcacaguggaaugauaguaaaugauacaggccaugaaacagaugaaaauagagcaaaaguagaaauaacaccaaauucaccgagagcugaggcaacacuaggaggauuugggagcuuaggauuagauugugaaccaagaacaggccuagacuuuagcgauuuauauuacuuaacaaugaauaauaaacacuggcuaguacacaaagaaugguuucaugacauaccuuuaccauggcaugcaggagcagacacugguacaccacauuggaacaauaaagaagcauuaguagaauuuaaagacgcccaugcgaaaagacaaacgguaguaguacuaggaagucaagaaggggcaguacauacagcuuuagcuggugcauuagaagcugaaauggauggagcaaaagguagacuauccucaggucacuuaaaauguagacuaaaaauggacaaauuaagguugaaaggaguaucauacaguuuauguacagcagcauuuacauuuacuaaaauaccugcagagacacugcauggaaccguuacaguggaaguacaauacgcaggaacagauggaccauguaaaguaccagcacaaauggcgguagauaugcaaacacuaaccccgguagguagauuaauaacagcaaacccugugauaacagaaagcacugaaaacucaaagaugauguuagaauuagacccaccauucggugauaguuauauaguaauaggagucggagaaaagaaaauaacacaucacuggcauagaagugguucaacaauagguaaagcguucgaagcaacaguucgaggagcaaaaagaauggccguacuaggagauacugcaugggacuuuggaucaguaggaggagcuuuaaacucucuagguaaagguauucaucaaauauucggggcugcuuuuaagagcuuauuuggcggaaugucuugguuuucacaaauauuaauaggaacacuauuaauguggcuaggacuaaauacgaaaaauggaagcauaagucugauguguuuagcacugggaggaguacucaucuuccuaagcacagcaguuucagccgauguaggauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4735 - RNA, 2332 nt, Artificial Sequence
  ZIKV prME variant mRNA Design 1 opt
gggagaaagcuuaccaugcgaggacuaucaucaagaaaaagaagaucacaugacguccuuacaguacaauuuuuaauauuaggaauguuauuaaugaccggagcaguaacuagacgaggaucagcauauuacauguaccuagaccgaaaugacgcaggagaagcuauaucauuuccuacaacccuaggaaugaacaaauguuacauacaaauaauggauuuaggacauaugugugaugccacaaugucauaugaauguccaaugcucgaugaaggaguagaaccggaugacgucgauuguuggugcaacacaacuucgacuuggguaguauacgguacuugucaucauaagaaaggagaagcgagacguucaaggagagcagugacacuaccgucucacucaacaagaaaauuacaaacaagaucacaaacgugguuagaaagcagagaauauacaaaacacuuaaucagaguggaaaauuggauauuuaggaacccaggcuucgcuuuagcagcggcagcaauagcaugguuacuaggauccagcacaucacaaaaaguaauauacuugguaaugauauuacuaauugcuccagcauacucaauuagauguauagguguaaguaacagagauuucguugaaggaaugaguggaggaacaugggucgauauaguacuugagcauggcggaugcguaaccguaauggcacaagauaagccaacuguagauauagaacugguuacaacaacagucucuaauauggcagaaguaagaagcuauuguuaugaagcgucaauaucagauauggcgucagacucaagaugccccacccaaggagaagcauaucuagauaaacaaagugacacacaauauguaugcaaaaggacucuaguagauagaggauggggaaauggguguggauuauucggaaaagggucccuaguaacaugcgcaaaauuugccugcucaaagaaaaugacagggaaaucaauucaaccagaaaaccuagaauacagaauaauguuaagcguucauggaagucaacauucggguaugauuguaaacgauacaggacaugaaacugacgaaaauagagcgaaaguugaaauaacaccuaauucaccaagagcagaagcaacucucggaggauucggaagucuuggacuggauugcgaaccacgaacaggguuagauuuuagcgaccuauauuaucuaacgaugaauaacaaacauugguuaguacacaaagaaugguuucaugacaucccacuaccauggcaugcaggagcagacacagguacgccacauuggaauaacaaagaagccuuaguagaauuuaaggaugcacaugcaaaaaggcaaacuguaguugucuuaggaagccaagaaggcgcaguacauacagcauuagcuggagcuuuagaggcugaaauggauggagcaaaagguagguuaucaaguggacauuuaaaaugucgauuaaaaauggauaaauuaagguuaaaaggaguaucuuauucauuaugcacagcagcauuuacauuuacaaaaauaccagcagaaacccuacaugguacaguaacaguagaaguccaauaugcaggcacagauggaccaugcaaaguuccagcucaaauggccguagauaugcaaacuuuaacacccguuggaagacuaauaacagcaaauccaguaauaacagaaucaacagaaaauaguaaaaugaugcuagaacuagaucccccauuuggcgauagcuauauagucauaggggucggagaaaagaaaauuacacaucacuggcaucgaucaggcaguacaauagguaaagcauuugaagcaacaguacgaggagcuaaaagaauggcaguccuaggagauacagcuugggacuuugguucaguaggaggagcauuaaacucauuaggaaaagguauacaucaaauauuuggagcagcuuucaaaucauuauuuggaggcaugucuugguuuagucagauacuaauaggaacucuauuaaugugguuaggcuuaaauacuaaaaauggaagcauaucuuuaaugugucuagcuuuagguggaguauuaauauuuuuaagcacagcuguaucagcugauguaggcuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4736 - RNA, 2332 nt, Artificial Sequence
  ZIKV prME variant mRNA Design 1 opt
gggagaaagcuuaccaugaggauaauaaaugcccgcaaagaaaagaaacggagaggagccgauacaucuguagguauuguaggauuauuauuaacaacagcgauggcagcagaaguaacaagaagaggaucagcuuauuauauguauuuagacagaaacgaugcaggagaagcaauuagcuuuccaacuacauuagguaugaauaaauguuauauacaaauaauggauuuaggacauaugugugaugcgacaauguccuaugaauguccaaugcuagaugaagguguagagccagaugauguagauugcugguguaauacaacaucaacaugggucguauauggaacaugccaucauaagaaaggugaagcaaggcguaguaggagagcaguuacauuaccaucucauucuacuagaaaacuacaaacaagaucacaaacaugguuagaaagucgagaauauacuaaacauuuaauaagaguagaaaacuggauuuuuagaaacccaggauuugcacuagcugcagcugcaauagcaugguuguugggaagcaguacaagucagaaaguaauuuauuuaguaaugauauuauuaauugcaccagcauauucaauuagauguauagguguaucuaacagagacuuuguagagggcaugucaggaggaacauggguugauauuguuuuagaacaugguggauguguaacuguaauggcucaagauaaaccaacaguagacaucgaauuagugacuacaacaguaucaaacauggcugagguuagauccuauuguuaugaagccucaaucagcgauauggccagugauaguagauguccaacacaaggugaagcauauuuagauaaacaaagugauacgcaauauguuuguaaaaggacguuaguagaucggggcuggggaaacggaugcggcuuauuuggaaaaggaaguuuaguaacaugugcaaaauuugcaugcucaaagaaaaugacagguaaaagcauucagccugaaaauuuagaauauagaauaaugcuaaguguacauggcagucaacauucaggaaugauuguaaaugacacgggacacgaaacagacgaaaacagagcaaaagucgaaauaacgccuaauaguccaagagcagaagcaacuuuagguggauuuggaagccuuggacuagauugugaaccacgaacugguuuggauuucagugauuuauacuauuuaacuaugaauaacaaacacugguuaguacauaaagaaugguuucaugacaucccauuaccauggcaugcaggagcggauacugggacaccacauuggaacaauaaagaggcguuagucgaguucaaagaugcacaugcgaaacgacagacaguaguaguauugggaagucaagaaggagccguacacacagcauuagcuggagcauuagaagcugaaauggacggagcaaaaggaagauuaucaucuggacacuugaaauguagauuaaaaauggauaaacucagacugaaaggaguaagcuacagucuauguacagcagcauucacauuuacaaaaauuccugcagaaacacuacauggaacaguuacaguagaaguacaauaugcaggaacagauggaccauguaaaguaccggcacaaauggcuguagacaugcaaacacuuacgccuguaggaagguuaauuacagcaaacccugugauaacagaaaguacggaaaauucaaaaaugauguuagaacuagacccuccauucggugauaguuauauagucauaggaguaggugaaaagaaaauuacacaccauuggcaucgcucaggcucaacaauaggaaaagcguuugaagcgacaguaaggggagcaaaaagaauggcaguguuaggggauacagcaugggauuucggaucgguaggaggugcauugaauagucuaggaaaagguauucaccaaauauuuggagcagcguucaaaucauuauuuggggguaugaguugguucucacaaauauuaauagggaccuuauuaauguggcuaggacuaaauacgaaaaaugguucaauuagucucauguguuuagcauuagguggaguauugauauuccuaaguacagcaguauccgcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4737 - RNA, 2329 nt, Artificial Sequence
  ZIKV prME variant mRNA Design 1 opt
gggagaaagcuuaccaugauaauuaacgcaagaaaagaaaaaaagagaaggggggcagacacaucuguaggaaucguaggguuauuauuaacaacagcuauggcagccgaaguaacgcgaagaggaucagcuuauuauauguauuuagacagaaacgaugcaggagaagcaauaaguuuuccaacuacucuaggaaugaauaaauguuacauacaaauaauggauuuaggacacaugugugacgcaacaaugagcuaugaaugcccaauguuggaugaaggcguagagcccgaugauguggauuguugguguaauacaacaagcacuugggugguauauggcacuugccaucacaaaaaaggcgaagcaagaaggucuagaagagcaguaacauuaccaucccacucaacaagaaaauuacaaacaagaucccaaacauggcuagaaucuagagaauauacaaaacauuuaauucgcguagaaaauuggauauucagaaauccgggguuugcacuagcagcagcugcaauagcauggcuauuaggaucaucgacaagccaaaaaguaauauauuuaguaaugauacuacucauagcaccugcauacucaauaagauguaucgguguaucaaauagagauuucguggaaggcaugagugguggaacauggguugacauaguuuuagaacauggagguuguguuacuguaauggcucaagauaaaccaacaguagauauagaacucguaacaacaacaguuucaaauauggcggaaguaagaaguuauuguuaugaagcuucuauuucagauauggccagcgacagucguugcccaacacaaggugaagcauaucuagacaagcaaagugauacucaauauguaugcaaaagaacacuaguagacagagguugggguaauggaugugguuuauuuggaaaaggaagccuaguaacaugcgcaaaauuugcuugcaguaaaaaaaugacagggaaaaguauacagcccgaaaaccucgaguauagaauaauguuaucuguacauggaucacaacacagcggaaugauaguaaaugauacaggacacgaaacagaugaaaacagagcaaaagucgaaauaacaccaaauaguccucgagcugaagcuacauuaggaggauucggaucgcuaggguuagauugcgaaccuagaacuggauuagacuuuucugauuuauauuaccugacaaugaacaacaaacacuggcuuguacauaaagaaugguuccaugauauuccauuaccauggcaugccggagcagauacaggaaccccccauuggaauaauaaagaagcauuaguagaauucaaagacgcgcacgcuaaaagacaaacaguaguaguacuaggaucacaagaaggagcuguacauacagcauuggcaggagccuuagaagccgaaauggacggagcaaaaggucgucuuucaagcggacauuugaaauguagacuaaaaauggauaaacucagacuaaaagggguaucauauucacuauguacagcagcauuuacauuuacaaaaauaccagcagaaacauuacaugguacagucacaguagaaguucaauaugcaggaacagaugguccguguaaaguaccugcacaaauggcaguagauaugcagacauuaacaccgguugguagguuaauuaccgcaaauccaguaauaacagaaaguacagaaaauucaaaaaugauguuagaauuagauccaccauuuggagacagcuauauaguaauaggaguaggugaaaaaaaaauaacacaucauuggcauagaaguggaucaacaauaggaaaagcauuugaagcaacggucagaggagcaaaaagaauggccguuuuaggggauacagcaugggauuuuggaaguguagguggagcauuaaacucuuuagguaaaggcauacaucaaauauuuggagcggcuuuuaaaaguuuauucggugguaugucaugguuuagucaaauacuaauaggaacuuuauuaaugugguugggauuaaauacaaaaaacgguucgauuaguuuaaugugcuuagcauuaggcggaguauuaauauucuuaaguacggcgguaagugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4738 - RNA, 2326 nt, Artificial Sequence
  ZIKV prME variant mRNA Design 1 opt
gggagaaagcuuaccaugauaaaugcaaggaaagaaaaaaaaagaagaggagcagauacauccguuggaauaguuggacugcuauuaacaacagcuauggcagcagagguuacacgaagaggaagcgcauauuauauguaucuagauagaaaugaugcaggagaagcuauaaguuuuccgacaacauuaggaaugaauaaauguuauauacaaauaauggaccuaggacauaugugugaugcaacaaugaguuaugaauguccaauguuggacgaaggaguagaacccgacgacguagauuguugguguaauacaacaagcaccuggguaguauauggcacaugucaccauaagaaaggagaagcaagaagaucacgaagagcgguaacauuaccaucacauucuacacgaaaauuacaaacaaggucacaaacaugguuagaaagcagagaauauacaaaacauuuaauucgaguggaaaauuggauauuuagaaauccaggauuugcacuagccgcagcagcaauagcaugguuacuaggaucaucaacaucacaaaaaguaauauauuuaguaaugauacuacuuauagcaccagccuacucaauuagaugcauuggaguaucuaauagagauuucguagaaggaaugagcggaggaacuuggguggauauuguauuagaacacggaggauguguaacaguaauggcucaagauaagccaacaguagacauagaauuaguaacaacuacaguaaguaauauggccgaggucagaagcuacugcuaugaagcaucaauuucagauauggcaagcgauucaagauguccaacacaaggugaagcuuauuuggacaaacaaagugacacacaauauguaugcaaacgaacacugguagaucgcggauggggaaauggauguggauuauuuggaaaagggucauuaguaacaugugcaaaauucgccuguucaaaaaaaaugacuggaaaauccauucaacccgaaaaucuagaauauagaauaauguuaaguguacauggaucacaacauucugguaugauaguaaaugauacaggucaugaaacagaugaaaaccgcgcaaaaguagaaauaacaccuaacucaccuagagcagaagcaacacuaggaggauuuggaagcuuaggguuggacugugaaccuagaacaggacuggacuuuucugacuuauauuaucuaacaaugaacaauaaacauugguuaguacauaaagaaugguuccaugauauaccauuaccauggcaugcaggagcugauacaggaacaccucacuggaacaauaaagaagcacucguagaauuuaaagaugcccaugcgaaaagacaaacuguaguaguuuuaggaucccaagaaggcgcuguacacacugcacuagcuggggcauuagaagccgaaauggacggugcaaagggacgauuaucauccggacauuugaaaugucguuuaaaaauggacaaauuaagacuaaaaggaguaucguauucacuauguacagcagccuuuacuuuuacaaaaauaccagcagaaacauuacauggaacaguuacaguugaaguacaauaugccggaacagacggaccaugcaaaguuccagcacaaauggcuguagauaugcaaacauuaacuccaguaggcagauugauaacagcaaacccugucauaacagaaucaacugaaaacaguaaaaugaugcuugaacuagaccccccauuuggagacucauacauaguaauagggguaggugaaaaaaaaauaacacaccauuggcauagaaguggauccacaauagguaaagccuuugaagcaacuguacguggagcaaaaagaauggcagucuuaggggauacagcaugggauuuuggaucaguaggaggagcuuuaaacucuuuaggaaaaggaauacaucaaauauuuggagcagcauucaaaucacuuuuuggaggaaugucaugguuuucucaaauucuaaucgggacacuacuuauguggcuaggauuaaauaccaaaaacggcaguauaucacugauguguuuggcauuagguggaguuuuaauauuuuugagcacagcggugucagcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4739 - RNA, 2323 nt, Artificial Sequence
  ZIKV prME variant mRNA Design 1 opt
gggagaaagcuuaccaugaaugcgaggaaagaaaagaaaagaagaggugcagauacaucagucggaauaguaggacuguuauugacaacagcgauggcagcagaaguaacaagaagaggaagcgcauauuauauguacuuagauagaaacgaugcuggugaagcaauaucauuuccuacaacauuaggaaugaacaaauguuauauacaaauaauggauuugggacauaugugugaugcuacaaugaguuaugaauguccaauguuggaugaaggaguagagccagacgauguagauuguugguguaacacaacaucaacauggguaguauaugggacuugucaccauaagaaaggggaagcucgacgaagccguagagcgguaacgcuaccaagccauagcacaagaaaauuacaaacgagaagucaaacuugguuagaaagcagagaauacacaaaacauuuaauaagaguagaaaauuggauauucagaaacccaggguuugcacuagcggcggcugcaauagcauggcuccuaggaucaucaacaucacagaaaguaauauaccuaguaaugauacuacuaauagcuccugcauauaguaucagauguauaggaguaaguaaucgagauuuuguagaagguauguccgguggaacguggguagacauaguacuagaacauggaggauguguaacagucauggcacaagacaaaccgacaguagacauagaauuaguuacgacaacaguaucaaauauggcagaagugagaucuuauuguuacgaagcaagcauaagcgacauggcaagugacagccguuguccaacacaaggagaagcauacuuagauaaacaaagugauacacaauauguauguaaaagaacgcuaguugacaggggcuggggaaacggaugcggcuuauucggaaaaggaucucuaguuacaugugcaaaauuugcauguucaaagaaaaugacaggcaaaucaauacaaccggaaaauuuagaauauaggauaauguuaucagugcaugguucacaacauucaggaaugauaguuaacgauaccggucaugagacagacgaaaauagagcaaaaguagaaauaacacccaacucaccaagagcagaagcaacacuagguggauucgguagcuuaggauuagacugugaaccaaggacaggauuggauuuuagugaccuauauuaccuaacaaugaauaauaaacacuggcuaguacauaaagaaugguuucaugauauaccguuaccuuggcaugcuggugcugauacagggacuccacauuggaauaauaaagaagcauuaguagaauuuaaagaugcgcacgcgaaaagacaaacgguaguaguauuagggucacaggaaggagcaguacauacugcacuagcaggagcauuagaagcagaaauggauggagcuaaaggaagacucagcucagggcacuuaaaaugcagauugaaaauggauaaauuaagacuuaaagguguuaguuauucucucuguacugcagcauuuacuuucacuaaaauaccggcagaaacacuucauggcacaguaacagucgaaguacaguacgcaggaacagaugggccauguaaaguaccagcacaaauggcuguagauaugcaaacguuaacaccuguaggacgauuaauaaccgcaaaccccguaauuacagaaucaacagaaaacucaaaaaugaugcuugaauuagacccaccauucggagauagcuauauaguaauaggagugggagaaaagaaaauaacacaucauuggcauagaagcgguucuacaauagguaaagcauucgaggcaacgguuagaggggcaaaaagaauggcgguauuaggagacacagcuugggauuucggaagcguagguggagcauuaaauucacuuggaaaagguauacaucaaauauuuggagcagcauucaaaaguuuauucggagguaugucaugguuuagucaaauuuugauaggaacauuacugaugugguuaggguuaaauacuaaaaacggaagcauuagcuuaaugugucuugcucuaggaggcguauuaauauucuuaagcacagcaguuagugcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4740 - RNA, 2320 nt, Artificial Sequence
  ZIKV prME variant mRNA Design 1 opt
gggagaaagcuuaccauggcuagaaaagaaaagaaacgaagaggcgcagauacaucaguaggaauaguuggucuauuacuaacaacugcaauggcagcagaaguaaccagaaggggaagugccuauuauauguaucuugauaggaaugaugcuggugaggcaauaucauuuccuacaacucuuggaaugaauaaaugcuacauacaaauaauggauuuaggucauaugugcgaugccacaaugucauacgaaugcccaaugcuagaugaaggaguagaaccugaugauguagacuguuggugcaacacaaccaguacauggguaguauauggaacuugucaucacaagaaaggagaagcaagaagaaguagacgagcaguaacgcuaccaagccacucaacacggaaauuacaaacaagaagccaaacaugguuagaaagcagagaguauacgaaacaccucaucagaguagaaaacuggauauuuagaaacccgggauuugcauuagcagcagcggcaauagcauggcuauuaggaaguuccacaagucaaaaaguuaucuacuuaguaaugauacuuuugauagcaccagcauacucaauuagauguaucgggguuucuaauagagauuuuguagaaggaaugaguggagguacauggguagauauaguauuagaacacggaggaugugucacaguaauggcacaagauaaaccaacaguugacauagaauuagugacaacaacaguaagcaauauggcagaaguacgauccuacuguuacgaagcaaguauaagcgauauggcuagugacucacgauguccuacucaaggugaggcuuaccuagauaaacaaagcgauacgcaguauguaugcaaaagaacauuaguagacaggggaugggguaacggaugcgggcuauuuggaaaaggcucucuuguaacaugugcaaaauucgcuuguaguaagaaaaugacggguaaaucaauacaaccagaaaaucuagaauauagaauaauguuaaguguacauggaucucaacauagugggaugaucguaaaugauacaggucacgaaacagacgaaaacagagcuaaaguagaaauaacaccaaauagcccgagagcagaagcuaccuugggaggauuuggaagccuaggucuugauugugaacccagaacaggauuagauuucucagauuuauauuaccuaaccaugaauaauaaacauuggcugguacauaaagaaugguuucaugauauaccuuuaccauggcacgcgggggcagacaccgguacuccacacuggaauaauaaagaggcauuaguagaauuuaaagacgcacaugcaaaaaggcaaacaguagugguacuagguagccaagaaggagcaguacauaccgcauuagcaggagcacuagaggcugaaauggauggagcaaaaggaagacuaucaucaggacaucuuaaaugucgauuaaaaauggacaaauuaagauuaaaagggguaagcuauaguuuaugcacggcagcuuuuacauuuaccaaaauaccagcagaaaccuuacaugguaccguaaccguugaaguucaauaugcuggaacagacggaccauguaaaguacccgcacaaauggcaguagauaugcaaacacuaacaccaguugggcgacugauaacugcaaauccaguaauaacagagucaacagaaaacucaaagaugauguuagaauuagauccaccauuuggugauucauauauaguaauaggaguuggagaaaagaaaaucacacaucauuggcauagaagcggaaguacuauaggaaaggcuuuugaagcaacaguaagaggagcaaaacgaauggcagucuuaggagauacugcuugggauuucggaaguguaggaggagcuuuaaacagccucgguaaagggauacaucaaauauuuggagcagcauuuaaaaguuuauuuggaggaaugaguugguuuucacaaauauuaauuggcacauuacuuauguggcuagguuuaaauacgaaaaacggaagcauauccuugaugugcuuagcacuuggagggguacuaauauucuugaguacagcaguaagugcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4741 - RNA, 2317 nt, Artificial Sequence
  ZIKV prME variant mRNA Design 1 opt
gggagaaagcuuaccaugagaaaagagaaaaaacgaagaggcgcagauacuaguguaggcaucguaggacuauuauuaacaacugcuauggcagcagaaguuacaagaagaggcagcgcauauuacauguauuuagaccgaaaugacgcaggagaagcuauuucauucccaacaacauuaggaaugaacaaauguuauauacaaauuauggacuuaggccacaugugugaugcaacaaugucauaugaauguccaauguuagaugaaggaguagaaccagaugauguagacuguuggugcaauacaacaaguacauggguaguauacgguacaugucaucauaaaaaaggugaagcaagaagaucuaggagagcaguaaccuuaccaucacauucaacaagaaaauuacagacaagaagucaaacgugguuagaaaguagagaauauacaaaacaucuaauuaggguagaaaauuggauauucagaaauccgggauuugcauuagcagccgcagcaauagcauggcuauuagggucuucaacaagucagaaaguaauuuaccuaguaaugauauuacuaauagcaccggccuacaguauacgguguauaggaguaaguaacagggauuucguugaaggaaugaguggagguacauggguagacauaguauuagaacaugguggauguguaacuguuauggcacaagauaaaccuacaguagacauugaacuaguuacaacaacaguuaguaacauggcagaaguaaggaguuauuguuaugaagcuucaauaagugauauggcaucagauucacguuguccuacacaaggagaagcuuauuuagauaaacaaagugauacacaauacguauguaaaagaacauuaguagaucgaggauggggaaaugguuguggucuauucggcaaagguucuuuaguaaccugugcaaaauuugcuugcagcaaaaaaaugacuggaaaaaguauccaaccagagaacuuagaauauagaauaauguuaaguguacauggaagccaacacucaggaaugauaguaaaugauacaggacaugaaaccgaugagaauagagcuaaaguagaaauaacaccaaacucaccucgagcugaagcaacauuaggaggauucggaucguugggauuagacugugaaccgagaacuggacuagauuuuucugauuuauauuauuuaacaaugaauaauaaacacugguuaguucauaaagaaugguuucaugauauaccauuaccuuggcaugcaggugcugauacuggaacaccacacuggaauaauaaagaagcauuaguagaauuuaaggaugcacacgcgaaaagacaaacaguaguaguuuuaggaagccaagagggagcaguacacacagcucuagcaggagcguuagaagcagaaauggauggugcaaaaggacgauuaucaucaggacaucuuaaaugucgacuaaaaauggacaaacugagacuaaaaggaguaucauauaguuuauguacagcagcguuuacauuuacuaaaauaccugcggaaacacuucauggaacuguuacgguagaaguacaauaugcaggaacugauggaccaugcaaaguaccggcccaaauggcaguagacaugcaaacuuuaacaccagucggaagauuaauaacugcaaaccccguaauaacagaaagcacugaaaacaguaaaaugauguuagaacuugaucccccauucggagauagcuauauaguuauaggcguaggagaaaagaaaauaacacaucauuggcacagaucaggaucaacaauaggaaaagcuuuugaagcuacagugagaggagcaaaaagaauggcaguauugggagauacagcuugggauuucgguucuguuggcggagcgcuaaauagucuaggaaaaggaauacaucaaauauucggugcugcauuuaaaucauuguucggaggcaugucaugguuuagccaaauuuuaauaggaacacuauuaaugugguuaggauuaaacaccaaaaauggcucuauuucacuaaugugcuuagcauuaggagguguauuaauauucuuaaguacagcgguuagugcggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4742 - RNA, 2314 nt, Artificial Sequence
  ZIKV prME variant mRNA Design 1 opt
gggagaaagcuuaccaugaaagagaaaaaaagaagaggagcagauacgucaguaggaauuguaggauuauuauugacaacagcaauggcagcugaagugacucguagaggaucagcauacuauauguauuuggaucguaaugacgcaggugaagcaauuucuuuuccuacaacauuagguaugaauaaguguuauauacaaauaauggacuuaggacacaugugugaugcaacaaugucauaugaaugcccuauguuagacgaagggguagaaccagacgauguugauuguugguguaauacuacaucaacauggguaguauacggaacaugucaccauaaaaaaggagaagcacgcagaaguagacgagcaguaacacuaccuucacauucaacaagaaaacuacagacgagaucacaaacuuggcuagaaaguagagaauacacaaaacaucuaauaagaguagaaaauuggaucuuuagaaauccagguuuugcguuagcagcagcagcaauagcuugguuguuagggucgucaacuagccaaaaaguaauauaucuaguaaugauauuauuaaucgcaccggcuuauaguauaagaugcauaggaguuaguaaucgagauuuuguagagggaaugucaggaggaacuuggguagauaucguucuagaacacggaggauguguaacaguaauggcacaggauaaaccaacaguugauauugaauuaguaacaacaacaguaagcaacauggcagaaguaaggaguuauugcuacgaagcuaguauaucagauauggcaagugauucaagauguccuacacaaggugaagcauauuuagauaaacaaagcgacacacaauaugucuguaaaagaacauugguugauagagguuggggaaaugguugcggauuauucggcaaagguucucuaguaacuugcgcaaaauuugcauguucaaaaaaaaugacagguaaaagcauacaaccagaaaacuuagaauauaggauuauguuaucgguucauggcucgcaacauagcgguaugauuguaaaugauacaggacacgaaacagacgaaaacagagcaaaaguagaaauaacuccaaauagcccaagagcagaagccacacuagguggauuugguaguuuaggacuagauugugaaccaagaacaggauuagauuuuagugaccuauauuauuuaacaaugaauaauaaacacugguuaguucauaaagaaugguuucacgauauuccauuaccuuggcaugcaggugcggacacaggaacgccacauuggaacaauaaagaagcuuuaguagaauucaaagaugcucaugcaaaaagacaaacaguaguaguacuaggaagucaagaaggagcgguacauacagcacuagcaggugcauuagaagcagaaauggauggagcgaaaggcagacuaucaucuggacaucuaaaauguagauuaaaaauggacaaacuaaggcuaaaaggaguaaguuacucacuauguacagcagcauucacauuuacaaaaauuccagccgaaacguuacacggaacaguaacggucgaagugcaauaugcaggaacugauggacccuguaaaguaccugcucaaauggcaguagauaugcaaacacuuacaccaguaggaagauuaauaacagcuaauccaguaauaacagaaucuacagagaacucaaaaaugaugcucgaauuagacccaccauucggugauaguuauauaguaauaggaguaggagaaaagaaaauaacacaucacuggcacagaucagguucaacaauuggaaaggcauuugaagcuacuguuagaggagcaaaacgaauggcaguauugggugacacggcaugggauuuuggaucaguaggaggagcuuugaauucucuaggcaaaggaauacaccaaauauucggagcagccuucaaaucucuauuuggagguaugagcugguucucacaaauauuaauagguacuuuauuaaugugguuaggauuaaacacuaaaaauggaucaauaucccuaauguguuuagcguuaggagguguauuaauauuccuaaguacagcugucagcgccgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4743 - RNA, 2311 nt, Artificial Sequence
  ZIKV prME variant mRNA Design 1 opt
gggagaaagcuuaccauggaaaaaaaaagacgaggggcggauacaucaguaggaauaguugguuuauuauuaacaaccgcaauggcagcagaaguaacuagaagaggaucagcauauuauauguauuuagauagaaaugaugcaggagaggcaauaucauuuccuacaacacuuggaaugaauaaauguuacauacagauuauggauuugggacacaugugugacgcaacaaugaguuacgaaugcccaaugcuagaugaagggguagaaccagacgacguggauuguugguguaacacaaccucaacgugggucguauacggaacaugccaccauaaaaaaggagaagcccgacggagucgaagagcagugacauuaccaagucauucaacgagaaaauuacaaacuagaagccaaacaugguuagaaagccgagaauacacaaaacaucuuauucgaguagaaaauuggauauuuagaaaucccggguuugcacuagcagcagcagcaauagcaugguuacuaggaucaucaacaucccaaaaagugaucuacuuaguaaugauauugcuuauagcgccagcauauaguauaagguguaucggaguaaguaauagagauuucguagaagguaugaguggaggaacauggguugacauaguuuuggagcauggcgggugcguaacaguaauggcacaagacaaacccacgguagacauagaauuagugacuacuacuguaucaaauauggcagaaguuagaagcuacuguuacgaagcaucaauaucugacauggcaagugauaguagauguccaacccaaggagaagcauaucuagauaaacaaucagauacacaauacguauguaaaagaacucuuguagaucgagguuggggaaaugguugcggcuuauuuggaaaaggaaguuuaguaacaugugcaaaauuugcauguucuaaaaaaaugaccgguaaaucgauacagccggaaaaccuagaauaccgaauuauguuaaguguacaugguucgcagcauucaggaaugauagugaacgacacaggucaugaaacagaugaaaaucgugcuaagguagaaauuacaccaaacucgccaagagcagaagcaacacuaggaggauuugguucacugggauuggauugugaaccuagaacaggccuugauuucucagauuuauauuauuuaacaaugaauaauaaacauuggcuuguacauaaagaaugguuucaugauauaccauuaccauggcacgcuggagcagacacggguacaccacauuggaacaacaaagaagcacuaguagaauuuaaggacgcccaugcaaaaagacaaacugugguaguacuagguagucaagaaggagcuguacauacugcucuggcaggggcauuagaagcugaaauggauggugcaaaaggaagauuaucaaguggacacuuaaaaugcagacuaaaaauggacaaauuaagauuaaaaggaguuucauauaguuuauguacagcagcauuuacuuuuacaaaaauuccagcagaaacauuacauggcacaguaacuguagaaguccaauaugcaggaacagacggaccuuguaaaguuccagcacaaauggcaguagacaugcaaacguuaacaccaguuggaagacuuauaacugcaaauccaguaauaacagaaaguacagagaauaguaaaaugaugcuagaauuagauccaccuuucggagauucauauauuguaauagguguaggagaaaaaaaaauaacacaccacuggcaucgaagugguaguacuauaggaaaagcauuugaagcuacagucaggggagcaaagagaauggccguacuaggagauacagcaugggacuucggaagcguuggaggugcccuaaauucauuagggaaagguauacaccaaauauucggcgccgcauuuaaaagccuauuuggaggaaugaguugguuuucacaaauacuaauaggcacauuauuaaugugguuaggcuuaaacacaaaaaauggaucaauaagucuaauguguuuagcauuaggaggaguauuaauuuuucuaucaacagcuguaucugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4744 - RNA, 2308 nt, Artificial Sequence
  ZIKV prME variant mRNA Design 1 opt
gggagaaagcuuaccaugaaaaaaagaagaggagcagacacaaguguaggaauaguaggacuauuauuaacaacugcaauggcagcagaaguaacaagaagaggaucagcguauuauauguaucucgauagaaaugaugcaggagaggcaauauccuucccaacaacucuuggaaugaacaaaugcuauauacaaauuauggauuuaggacauaugugcgaugcaaccauguccuacgaauguccaauguuagaugaagguguagaaccugaugauguagauuguugguguaauacaacaaguacuugggugguauauggaacaugccaucauaaaaaaggagaggcaagaagaagcaggagagcgguaacacuaccaucccauagcacacgaaaacuacaaacuagaagucaaacauggcuagaaagcagagaauacacuaaacaucuuauaagaguagaaaauuggauauuuagaaacccaggguuugcgcuagcagccgcagccauugcuugguuauuaggcucaucaacaagccaaaaaguaauauaccuaguaaugauacuacuaauagcgccugcauauucaauuagaugcauuggagucuccaauagagauuuuguagaaggaaugaguggagggacaugggucgacauaguacuagaacacggagguuguguuacagugauggcgcaagauaaaccaaccgucgauauagaauuaguaacuacaacaguaucaaauauggcagaaguaagauccuauuguuaugaagcaucgauaagcgauauggccucagauucuagaugucccacacaaggagaagcuuacuuagauaaacaaucugauacacaauaugucuguaaaagaacacucguagauagaggauggggaaauggauguggccuauucggaaaagguaguuuaguaacaugugcaaaauuugcauguagcaaaaaaaugacaggaaaaagcauucaaccagaaaaucuggaauauagaauaauguuaucuguacauggaagucaacauucagggaugauaguuaaugauacaggacacgaaacagaugaaaaucgagcaaaaguugaaauaacaccuaauaguccaagagcagaagcaacauuaggaggauuuggaagucuaggauuagacugugaaccuagaacuggauuggauuuuagugacuuauauuaucuuacuaugaauaauaaacacuggcuuguucauaaagaaugguuccacgauauaccacuaccauggcaugcaggcgcugacacagguacaccccauuggaauaacaaagaagcacuaguagaauucaaagaugcucaugcaaaaagacaaacagucguaguucuaggaagucaagaaggagcaguacacacagcuuuagcuggagcauuagaagcagaaauggauggugcaaaaggacgacuaucaucaggacacuuaaaaugcagacuaaaaauggauaaauuaagacuaaaaggaguaucauauaguuuguguacagccgcauuuaccuuuacaaaaauuccagcugaaacauuacacggaacuguaacaguggaaguacaauaugcagguacagacggaccguguaagguaccagcucagauggcaguagauaugcaaacauuaacgcccguugguagauuaauaacugcaaauccagugauaacagaaucaacagagaauagcaaaaugaugcuagaauuagaucccccauuuggagauagcuauauaguaauuggaguaggagaaaaaaaaauaacacaucauuggcaucgaucaggauccacuauagguaaagcuuuugaagcaacaguaagaggggcuaaaagaauggcgguauuaggagauacagccugggauuuuggaucagucggaggugcauuaaacaguuuagguaaaggaauucaucaaauauuuggagcagcauucaaaagcuuauuuggagguaugucaugguuuucgcaaauacugauuggaacauugcuaauguggcuaggacuaaauacuaaaaauggaaguaucucauuaaugugucuagcacuaggagguguauuaauauuucucagcacagcagucucagcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4745 - RNA, 2305 nt, Artificial Sequence
  ZIKV prME variant mRNA Design 1 opt
gggagaaagcuuaccaugaaaagaagaggugcagauacaucaguaggaauaguuggguuauuacuaacaacagcaauggcagcagaaguaacgagaagggguagugcguacuauauguaccuagaccgaaaugaugcaggugaagcuauaagcuuuccaaccacacuaggcaugaauaaauguuauauacaaauaauggaucuaggacauaugugugaugcuacaaugaguuacgaauguccaaugcuagacgaaggaguagagccagacgauguagacuguugguguaauacgacaucaacauggguaguauaugguacaugucaucacaaaaaaggcgaagcaagacgaucaaggagagccgucacucuaccaagucacagcacaagaaaacuacaaacuagaagucaaacaugguuagaaucaagagaauauacaaaacaucuaauaaggguggaaaacuggauauucagaaauccagguuuugcacuagcagcagcagcgauagcuugguuauuagguaguucuacuucacaaaaaguuauauacuugguaaugauuuuauuaauagcacccgcauacaguauaaggugcauuggaguaaguaauagagauuuuguagagggaaugaguggaggaacauggguagauauaguauuagaacauggaggcuguguaacugugauggcacaagacaaaccuacaguagacauugaauuaguaacgacaacaguuucaaauauggcagaaguaagaucuuauuguuaugaagcaaguauaagcgauauggcaagugacagcagauguccaacacaaggggaagcuuaucuugacaagcaaucagacacgcaauacguuuguaaacggacauuaguagauaggggcugggggaacggauguggauuauuuggaaaaggguccuuaguaacaugcgcaaaauucgccuguaguaaaaaaaugacaggaaaaucuauacaaccagaaaaucucgaauauagaauaauguuaucaguacauggaagucaacauucagggaugauaguaaaugauacuggccaugaaacagacgaaaauagagcaaaaguagaaauaacaccuaauagucccagagcagaagcaacauuaggaggauucggaucauuaggauuagacugugaaccaagaacaggccuagauuucucugacuuauauuaccuaacaaugaauaauaaacacuggcuaguucacaaagagugguuucaugacauaccgcuaccuuggcaugcaggugcagauacaggaacgccacauuggaauaauaaagaagcacuaguagaguuuaaagaugcucaugcaaaaagacaaacgguaguaguauuaggaagccaagaaggagcaguacacacagcucuagcaggagcucuugaagcagaaauggauggugcuaaaggucgauuaucauccggacacuuaaaauguagauuaaaaauggacaaacuaagauuaaaaggaguaagcuacagccuauguacagcagcauuuacauuuacaaaaauaccagcagaaacuuuacauggaacaguaacaguugaaguacaauaugcaggaacagaugggccauguaaaguuccugcgcaaauggcaguagacaugcaaacauuaacaccaguaggaagauugauaacagcaaauccaguaauaacugaaucaacugaaaacucaaaaaugaugcuagaacuagacccaccauucggagauagcuauauaguaauuggaguuggcgaaaaaaaaauaacacaucauuggcacagaaguggaaguacgauuggaaaagcauuugaggcaacaguaagaggugcuaaaagaauggcaguacuuggagacacagcuugggauuuugguagcguaggaggagcauuaaauucacuuggaaaaggaauucaucaaauauucggagcagccuucaaaucacuauuuggaggaaugaguugguuuucacagauauuaauugggacacuucuaauguggcuaggauugaauacaaaaaaugggaguauaucuuuaaugugucuagcauuaggggguguauuaauauucuugucaacagcugugucugccgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4746 - RNA, 2302 nt, Artificial Sequence
  ZIKV prME variant mRNA Design 1 opt
gggagaaagcuuaccaugagaagaggcgcagauacaucagucggaauuguuggucuuuuguuaacuacagcaauggcagcagaaguaacaagacguggaagugcguacuacauguaccuagacagaaaugaugcaggagaagcaaucucauuuccuacuacucuggguaugaacaaaugcuauauacaaauaauggaucuaggccauaugugugaugcgacaaugucauaugaguguccaaugcuagacgaagguguugaaccugacgauguagauugcugguguaacacaacaucaacauggguaguauauggaacaugccaccauaagaaaggagaagcuagaagaucaagacgagcaguaacauuacccagucauaguacaagaaaauuacagacaagaagccaaacauggcuagaaucgagagaauauacuaaacaucuaauaagaguagaaaauuggauauuccgaaacccaggauuugccuuggcagcagcugccaucgcauggcuuuuaggaaguucgacaagccaaaaaguaauauaucuaguuaugauacuucucauagcaccagcuuauucaauaagauguaucgguguuaguaacagagauuuuguagaagguauguccggagguacuuggguugauauaguauuagaacaugguggauguguuacuguaauggcacaagauaaaccaacaguagauauagaauuaguaacaacuacaguaagcaacauggcagaaguaagaucuuauuguuaugaagcaucaauaucagauauggcaagugauaguagaugcccaacccaaggagaagcauacuuagauaaacagucagauacacaauauguauguaaacgaacuuuaguugaucgaggguggggaaacggaugugguuuauuuggaaaaggaaguuuaguaacaugugcuaaauuugcaugcucaaagaaaaugacaggaaaaucaauacaaccagaaaauuuagaauauaggauaaugcuuagcguacauggaucacaacauuccggaaugauuguaaaugacacgggacaugaaacugaugaaaacagagcuaaagucgaaauaacaccuaauaguccucgagcagaagcaacauuaggaggauuugguagcuuaggacuugacugugaaccuagaacaggacuagauuuuagugaucuauacuaccuuaccaugaauaauaaacauuggcuaguacacaaagaaugguuucaugacauaccauuaccauggcaugccggagcagacacagguacaccucacuggaauaauaaagaagcccuaguagaauuuaaagaugcacacgcaaaacgacaaacagugguggucuuaggaagccaagaaggagcaguacauacagcauuagccggugcucuagaagcagaaauggauggugcaaaaggaagacuuagcucaggacauuuaaaauguagguuaaaaauggauaaauuaagguuaaaaggaguaucauauagucuaugcacagcagcauuuacuuucacaaaaauacccgccgaaacgcuacacggaacaguaacaguagaaguacaauacgcaggaacugaugguccauguaaaguaccagcucaaauggcaguagacaugcaaacauuaacaccaguagguagguuaauaaccgcgaauccaguaauaacugaaucaacagaaaauagcaaaaugauguuagaacuagacccuccauucggagauagcuauauaguaauagguguaggagagaagaaaaucacacaucauuggcauagaaguggaucaacaauaggaaaagcauuugaagcuacaguaagaggagcaaaacguauggcaguauugggagauacugcaugggauuuuggaaguguagggggagcucuaaauucacuuggcaaaggaauacaucaaauauuuggagcagcauuuaaauccuuauucggaggaaugucuugguuuagccaaauacuaauaggaacuuuauuaauguggcuuggacuaaacacuaaaaauggaucaauuucuuuaaugugucuagcucuaggaggaguacuuaucuuucuaaguacagcagugagugcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4747 - RNA, 2299 nt, Artificial Sequence
  ZIKV prME variant mRNA Design 1 opt
gggagaaagcuuaccaugagaggagcagacacaaguguagguauaguuggauuauuauuaacaacagcaauggcagccgaaguaacaagaagagguucagcuuauuauauguauuuagacagaaaugaugcaggagaagcaauaucauucccaaccacgcuuggaaugaauaaaugcuauauacaaauaauggauuuaggacacaugugugaugcaacaaugucauaugaaugccccauguuagaugaagguguagaaccagaugacguagacuguugguguaauacaacgagcacaugggucguauauggaacuugccaucauaagaaaggagaagcuagacgaagcagacgagcaguaacgcuaccaagucacucaaccagaaaauugcaaacaaggagucaaacauggcuagaaucaagagaauauacuaaacaucuuaucagaguagaaaauuggauuuuucgaaauccaggauuugcacuugcugcagcugcuauagcauggcuauuagguucaagcaccucacaaaaaguaauauaucuaguuaugauacuauuaauugccccugcauacucaauuagauguauaggaguaucaaauagagacuucguagagggaaugucaggaggaacuuggguagauauaguacuagaacaugguggauguguaacaguaauggcacaagauaaaccaacuguugacauagaauuaguaacaacaaccguaaguaauauggcagaaguaagauccuacugcuaugaggcaaguauaagcgauauggcaucagauagucgauguccaacacaaggggaagcauauuuagauaaacaaucagauacgcaauacgucuguaaaagaacauuaguggacagaggaugggguaaugguuguggacuauucggaaaagguagcuuaguuacaugugcaaaauuugcauguaguaagaaaaugacaggaaaaucaauucaacccgaaaacuuagaauauagaauaaugcuaucaguacauggaagucaacauucagguaugauuguaaacgauaccggccaugaaaccgaugaaaauagagcuaaaguagaaauaacgccuaauagcccaagagcggaagcaacacugggaggauuugggagcuuaggauuggauugugaaccaagaacaggacuagauuucucugacuuauauuaccuaaccaugaauaauaaacauugguuaguacauaaagaaugguuucaugauauaccacuaccguggcaugcaggggcagauaccggaaccccacacuggaauaauaaagaagccuuaguagaauuuaaagacgcgcaugcaaaaagacaaacuguaguaguauuaggaucacaagaaggggcaguucacaccgccuuagcaggagcacuagaagcagaaauggauggagcuaaaggucgacuaucaucaggacauuuaaaauguagacuuaaaauggauaaauuaagauuaaaaggaguuaguuacucauuaugcacugcagcauucacuuucaccaaaauaccagcagaaacauuacauggcacuguaacaguagagguacaauaugccggaacagauggacccugcaaaguaccagcgcagauggcugucgauaugcaaacauuaacuccaguuggucgacucauaacugcuaaucccguaauaacagaaucaacagaaaauucaaaaaugaugcuugaauuagauccucccuuuggagauucauauauaguaauaggaguaggggaaaagaaaauaacccaccauuggcauagaaguggaaguacaauugguaaagcauuugaagcaacaguuagaggagcaaaaagaauggcgguauuaggagauacagcgugggacuucggcagcguaggaggcgccuuaaauucuuuaggaaaagggauacaucaaauauuuggagcagcauucaaaucauuauucggaggaaugucaugguuuucacaaaucuuaauaggaacucuauuaaugugguuaggucuaaauacuaaaaacggcucaauaaguuuaauguguuuggcacuaggcggaguacuaauuuuccuaucgacagcaguauccgcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4748 - RNA, 2296 nt, Artificial Sequence
  ZIKV prME variant mRNA Design 1 opt
gggagaaagcuuaccaugggagcggauacaucaguugguauaguaggacuguuauuaacaacagcuauggcugcagaaguaaccagaagaggaucagcauauuauauguauuuagauagaaaugaugcuggagaagcuauaucauuucccaccaccuuaggaaugaauaaauguuacauucaaauaauggauuugggacacaugugcgaugcaacaaugagcuaugagugucccauguuagacgaaggaguugaaccagaugacguagauuguugguguaauacgacaaguacuuggguaguauacggcacaugucaucacaagaaaggagaagcacgccgcucaagacgagcuguaacccuucccagucauaguacaaggaaauugcaaacucguagccaaacaugguuagaauccagagaauauaccaaacaucucauaagaguagaaaacuggauauuuagaaauccaggauucgcauuagcugcagcagcaauagcauggcuccuaggaucaagcacaucccaaaaaguuauauaccuaguuaugauauuauuaauagcuccagcauauucaauuagauguauaggaguuucaaaccgugacuuuguugaaggcaugucaggaggaacauggguagauauaguacuagaacacggaggauguguaacuguaauggcacaagacaaacccacaguugauauagagcuaguuacuacaacaguaaguaauauggcagaaguaagaaguuauugcuacgaagcaucaauaagugauauggcaagugacaguagaugcccaacccaaggagaagcguacuuagacaaacaaagugauacccaauauguuuguaaaagaacacuuguugaucgaggauggggaaauggaugcggacucuuugguaaaggaucauuaguaacaugugcaaaauuugccuguagcaagaaaaugacaggaaaaucaauacaaccagaaaaccuagaauauagaauaauguuaucuguacaugguucacaacauucagguaugauugucaacgacacaggacaugaaacugaugaaaauagagcaaaagucgaaauaacuccaaauucaccacgagcagaagccacuuuaggggguuuuggaagucuaggauuagacugugaaccaaggacaggauuagauuuuucagaucuauauuauuuaacaaugaacaacaaacauuggcuaguacacaaagaaugguuucaugacauaccauuacccuggcacgcaggcgcugacacuggaacuccgcacuggaauaauaaagaagcccuaguugaguucaaagacgcacaugcaaaaagacaaacaguaguuguauuaggaucacaagaaggagcuguacauacagcauuggccggagcauuagaagcugaaauggauggagcaaaagguagacuaagcagcggccaucucaaaugcagauuaaaaauggacaaacuaagacuaaaaggcguuucauacucacuauguacagcagcuuuuacauuuacuaaaauaccugcagaaacauuacaugguacaguaacaguugaaguacaauaugcaggaacagauggaccaugcaaaguaccagcacaaauggcagucgauaugcagacauuaacgccaguaggacgacuaauaacagcaaauccuguaauaacagaaagcacagaaaauucaaaaaugaugcuagaacucgacccucccuucggggauucauauauaguaauaggaguaggcgaaaagaaaauaacacaccauuggcaucguucaggaaguacuauaggaaaagcauucgaagccacaguaagaggugcaaaaaggauggcaguguuaggagauacagcaugggauuuuggaucagucggaggagcacuaaauagcuuaggaaaaggaauacaucagauauuuggagcagcauuuaaaaguuuauucgguggaaugucuugguucucucaaauuuuaauaggaaccuuacuuaugugguuggggcuaaauaccaaaaauggaucaauaucauuaaugugcuuagcucuaggagguguacuaauauuucuaucgacagcaguguccgcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4749 - RNA, 2293 nt, Artificial Sequence
  ZIKV prME variant mRNA Design 1 opt
gggagaaagcuuaccauggcugauacaucaguaggcauaguaggucuacuuuuaacaacagcaauggcagcugaaguaacaaggcgagguagcgcuuauuacauguacuuagauagaaaugaugcaggggaagcuauaucuuuuccgacaacauuaggaaugaauaaaugcuauauucaaauaauggaccugggacauaugugugaugcgacaaugaguuaugaaugcccaauguuagaugaaggaguugaaccggaugacguagacugcugguguaauacaacaaguacaugggucguauaugguacaugucaucauaaaaaaggagaagcaagaagaucaagaagagcaguuacauuaccuucacacucuacaagaaaauugcaaacacgaagccaaacguggcuugaaucaagagaguacacaaaacauuuaauccgaguagaaaauuggauuuucagaaauccaggauucgcacuagccgcagcagcaauagcaugguuacucggaucaaguacaucacaaaaaguaauuuacuuaguaaugauauuacuaauagccccagcauauaguauaagauguauaggaguaaguaauagagauuuuguggaaggaaugaguggagguacguggguagauauuguauuagaacaugguggauguguaacaguaauggcacaggauaaaccaacaguagacauugaauuaguaacaacaaccguaucaaacauggcagaaguaagaucauacuguuaugaagcaaguauaucugauauggcgagcgacucaagauguccuacacaaggugaagcguaucuagauaaacaauccgauacucaauauguauguaaaagaacccuaguagacagaggguggggcaaugguugugguuuauuuggcaaaggaucauugguaacaugugcaaaauucgcaugcucaaaaaaaaugacuggaaaaucaauucagccggaaaaccuagaauauagaauaauguuaucuguucacggaagucaacacucaggaaugauuguaaacgauacuggucacgaaacugaugaaaauagagcuaaaguagaaauaacaccaaauaguccaagagcagaagccacccuugguggauucggaagucuaggauuagauugcgaaccaaggaccggauuagacuucucagauuuauauuaucuaacuaugaauaauaaacauuggcuaguacacaaagaaugguuucacgauauaccuuuaccauggcaugcaggagcagauaccgguacaccacacuggaacaauaaagaagcuuuaguagaauuuaaagaugcucacgcaaaacgacaaacgguuguaguacuaggaucacaagaaggagcaguccacacagcauuagcgggagccuuagaagcagaaauggauggagcaaaaggaagacuuaguucaggacauuuaaaaugccgauuaaaaauggauaagcuuagacuaaaaggaguaaguuacagccugugcacagcugcauuuacauuuacaaaaaucccagcggaaacauuacauggaaccgucacaguagaaguacaauacgccggaacagauggcccaugcaaaguaccagcucaaauggcuguagauaugcaaacacuaacaccaguaggaagacuaauaacagccaacccaguaauaaccgagucuacagaaaacaguaaaaugauguuagaacucgauccuccauuuggagauagcuauauaguaauugguguaggagaaaaaaaaauaacacaucauuggcaucgaucagguucaacaauagguaaagcauuugaagcuacaguacgaggagccaaaagaauggcaguauugggugauacagcaugggauuuuggaucugucggaggagcauuaaacucauuaggaaaagguauacaucaaauauuuggugcugcauucaaaagcuuauuuggaggaaugucaugguuuucccaaauucuaauaggaacauuauuaaugugguuaggauuaaacacgaaaaaugggucaauaagucuaaugugccuugcauuagguggaguacuaauauuucuaagcacugcaguaucagcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4750 - RNA, 2290 nt, Artificial Sequence
  ZIKV prME variant mRNA Design 1 opt
gggagaaagcuuaccauggacacaaguguaggaauaguaggauuguuauuaacaacugcaauggcagcagaagucacucgucgugguagcgcauacuauauguauuuagauagaaaugaugcaggagaagcaauaucuuuuccgacaacauuaggaaugaacaaauguuauauacaaauaauggauuuaggucauaugugugacgcuacgaugucauaugaauguccaauguuggaugaaggaguagaaccagaugacgucgauuguuggugcaauacgacauccacauggguaguuuaugggacaugucaucauaagaaaggagaagcgaggagaagcaggagagcaguaaccuuaccaagucacagcacaagaaaacuacaaacaagaagucaaacaugguuagaaucaagagaauauaccaaacacuuaauaaggguggaaaauuggauauuucgaaauccaggauuugcauuagcagcagcugcaaucgcgugguuauuaggaucaucaacaucacagaaaguaauauaccuaguuaugauauuauuaauagcaccagcauauagcauaagaugcauaggagugaguaauagagauuuuguagaaggaaugaguggaggcaccuggguagauauaguacuagaacauggcggaugugucaccguuauggcucaagauaaaccaacaguagauauagaauuaguaacuacaacaguaucaaauauggcagaaguaagaaguuacugcuaugaggcuucaauaagugacauggcuucagauucaagauguccgacacaaggagaagcauauuuagauaaacagucugauacucaauauguaugcaaaagaacccuaguagacagaggauggggaaaugguugugguuuauucggaaaaggaagucugguuacaugugcaaaauucgcaugcucuaagaaaaugacaggaaaaucaauccaaccagaaaaccuagaauacagaauaauguuaucaguacacggcucacaacauaguggaaugauagugaaugauacuggacacgaaacugaugaaaaucgagcaaaaguagaaauaacacccaacaguccgagagcagaagcuacauuaggaggauuugguucauuaggauuggauugcgaaccaagaacagguuuagacuuuagugauuuauauuaucuuaccaugaauaacaaacauuggcuuguacauaaagaaugguuucaugacauuccucuaccauggcaugccggagcagauacggguacuccacacuggaauaauaaagaagcauugguagaauuuaaagaugcacaugcaaaaagacaaacuguaguaguauuaggaagucaagaaggagcaguucauacugcguuagcuggagcauuagaagccgaaauggauggagcaaagggaagauuaucaaguggacaccuuaaaugccgacugaaaauggauaaacuaagacuuaaagguguuucuuauucuuuauguacugcggcuuucacauuuacgaaaauacccgcugaaacacuucaugguacuguaacaguagaaguacaauaugcaggaacagacggaccauguaaaguaccagcacaaauggcagucgauaugcaaacacuuacaccaguagguagacuuaucacagcgaauccaguuauaacugaaaguacagaaaauaguaaaaugaugcuggaauuagauccuccuuucggagacaguuacauaguuauugguguaggggaaaagaaaauaacacaucacuggcauagaaguggaucaacuauaggaaaagcauuugaagcaacaguccguggagcaaaacgaauggcaguacuaggcgauacugcaugggauuuugguagcguugguggagcacuaaauucacuuggaaaaggaauacaccaaauauuuggagcagcauuuaaaucacuuuuugguggcaugucaugguuuucacaaauuuuaauuggaacauuauuaauguggcuaggauuaaauacuaaaaacgguaguauaucguuaaugugucuagcacuagguggagucuuaauauuucuuaguacagcaguuagugcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4751 - RNA, 2287 nt, Artificial Sequence
  ZIKV prME variant mRNA Design 1 opt
gggagaaagcuuaccaugacaagugucggaauaguaggauuauuguuaacaacggcaauggccgcagaagugacgagaagggggucugcuuauuauauguaucuugauagaaaugaugcaggagaagcuauaaguuuuccaacaacucuaggaaugaauaaauguuacauucagauaauggacuuagggcauaugugcgaugcaacaaugucauacgagugcccaaugcuagaugaaggaguagaaccagaugacguugacugcugguguaauacaacuucaacauggguagucuacgguacaugucaucacaaaaaaggagaagcaagaagaucuagaagggcagugacauuaccuagucauagcacgaggaaacuccaaacccgaucacaaacauggcuagaaagcagagaauauacaaagcaccuaauaagaguagaaaauuggauuuuuagaaauccaggauucgcauuagcagccgcugcgauugcaugguuacuuggaucaaguacgucgcaaaaaguuauauacuuaguaaugauauugcuaaucgcaccagcauauucgaucagaugcauaggaguaucaaacagagacuucguagaaggaaugaguggaggaacauggguagauauaguacuagaacauggagguugugugacaguaauggcacaagauaaaccaacuguggacauagaacuagugacaacaacaguaucaaacauggcagaaguacgaucuuacuguuaugaagcgucaauaagcgauauggcaagcgauaguagaugcccaacacaaggagaagcauacuuagauaaacaaucagauacucaauauguauguaaacgaacacuaguagauagaggauggggaaauggauguggauuauuuggcaaaggaagucugguaacuugugcaaaauuugcuugcaguaaaaaaaugacaggaaaaaguauacaaccagaaaaccuugaauauaggauuauguuaaguguucacgggagucaacauagugggaugauugucaaugauacaggacaugaaacagacgaaaauagagcaaaagucgaaauaacgccaaacaguccaagagcugaagcgacauuaggaggauuuggaucauuaggacuagauugugaaccaagaacugggcuagacuuuucagacuuauacuaucuaacaaugaauaauaagcacugguuaguucauaaagaaugguuucaugacauaccacuaccuuggcaugcaggagcagauacuggaacuccgcauuggaauaauaaagaagcauuaguagaauucaaagaugcacaugcaaaacgacagacaguagucguacuuggaagucaagaaggagcggugcauacagccuuagcaggagcauuagaagcagagauggacggcgcuaaagguagacuuagcagcggacaucuaaaauguagacuaaaaauggauaaacuaagacuaaaaggaguaucauauucauuauguaccgcagcguucacauuuacaaaaauaccagcggaaacauuacauggaacuguaacaguagaaguacaauaugcaggaacugauggaccauguaaaguaccagcacaaauggcaguagauaugcaaacauuaacacccguaggaagacuaauaacagcaaauccaguaauaacagaaaguacagaaaauucuaaaaugauguuggaauuagacccaccuuuuggagacaguuacauaguaauaggaguaggagaaaaaaaaauaacacaccauuggcauaggaguggaagcaccauaggaaaagcauuugaagcuacuguaagaggagcgaaacgaauggcuguucuaggagauacggcuugggacuuuggaaguguaggaggagcguuaaauagucucggcaaaggaauucaucaaauauucggagcagcauuuaaaucacuauuugguggaaugucaugguuuagucaaauauugauaggaacacuauuaaugugguuaggauuaaauacuaaaaacggcaguauaucacuaaugugcuuagcauuagguggaguuuuaauauuccuaaguacagcaguaagugcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4752 - RNA, 2287 nt, Artificial Sequence
  ZIKV prME variant mRNA Design 1 opt
gggagaaagcuuaccaugacaucaguaggaauuguugguuuacuauuaacaacagcaauggcagccgcaguaacacgccgaggcucggcuuacuauauguauuuagauagaaacgaugcaggagaagcaauaucauuuccaaccacacuggguaugaauaaaugcuauauccaaauaauggaucuaggacauaugugcgacgcaacaaugucauaugaauguccaaugcuagaugaaggagucgaaccagaugauguagauugcugguguaauaccacaaguaccuggguaguauauggcacaugucaucauaagaaaggcgaagcaagaagaaguagacgagcaguaacauuaccaucacauucaacaagaaaacuucaaacaagaagccaaacuuggcuagaaagcagagaauauacaaaacauuuaauaagaguggaaaauuggauauucagaaauccuggcuuugcauuagcugcagcggcuauagcuugguuacuuggaucuaguacuucacagaaaguaauauaucuaguaaugauacuauuaauagcaccagcuuacaguauccgaugcauaggaguaucgaacagagauuuuguagaagggaugucagguggaacauggguagauauaguauuagaacacggcggaugcguaacaguaauggcacaagacaaaccaacaguagacauagaacuuguaacaacaacaguaucaaauauggcagaaguuagaucauacugcuaugaagcaucaauaucagacauggcuucagauaguagauguccaacacaaggagaagccuacuuagauaaacaguccgauacucaauauguauguaaaagaacccuaguagaccgcgguuggggaaaugguugcggacuauucggaaaaggaagucuaguaaccugugcaaaauuugcauguaguaagaaaaugaccggaaaaaguauucaaccagaaaauuuagaauauagaauaauguuaaguguacauggcucucaacauucaggaaugauagucaaugauacaggucaugaaacagaugaaaauagagcuaaagucgaaauaacaccaaauucaccacgugcugaagcaacacuaggaggauuuggaucacucggauuagauugugaaccaaggacaggcuuggauuucucagauuuauauuaucuaacuaugaacaacaaacauugguuaguccauaaagaaugguuucacgauauaccucuaccauggcaugcuggugcagauacaggaacaccccauuggaauaauaaagaagcucuagucgaauuuaaagaugcacacgcaaaacgccagacaguaguuguacuaggaagccaagaaggagcaguacacacagcucuagcaggagcuuuagaagcagaaauggauggugcaaaaggaagacuaagcucaggacaucugaaaugcaggcuaaaaauggauaaauuaagauuaaaaggaguaagcuauucauuauguacagcagcauuuacauucacaaagauaccagcggaaacauuacacgggaccguaaccguagaaguacaauaugcagguacagacggaccauguaaaguaccagcacaaauggcaguagacaugcaaaccuuaacaccaguaggucgauuaauaacagccaauccaguaauaacagaaucaaccgaaaauuccaaaaugaugcuagaauuagauccaccuuucggagauaguuauauaguaauaggaguaggagaaaagaaaaucacacaucacuggcauagaucuggcuccacuauaggaaaagcauuugaagcuaccguuagaggagcaaaaagaauggcugucuuaggagauacugcaugggacuuuggaaguguuggaggugcacuuaacagccuaggaaaaggaauacaucaaauauucggugcagcuuuuaaaagucucuucgguggaauguccugguucucucaaauuuuaauagguacacuacuuauguggcuuggucuaaacaccaaaaauggaucaauaucauuaaugugccuggcacuaggaggaguacuaauauucuuaucaacagcuguaagcgcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4753 - RNA, 2299 nt, Artificial Sequence
  ZIKV prME variant mRNA Design 1 opt
gggagaaagcuuaccaugagaggagcagauacaaguguugguauaguaggcuuacuauuaacaacagcaauggccgcugcuguaacacgaagaggaagugcauauuacauguacuuagaccgaaacgaugcaggagaagccauaucauuuccaacaacguuaggaaugaacaaaugcuacauacagauaauggaucuaggacauaugugugacgcaacgaugucauacgaauguccaauguuagaugaaggcguagaaccagaugauguagauuguuggugcaacacaacaaguacauggguaguauauggcacaugucaccauaaaaaaggggaagccagaagaagcagaagagcgguaacacuaccuucacauaguacuagaaaacuucaaacgcgcucucaaacauggcuugagaguagagaguauacaaaacauuuaauuagaguagaaaauuggauauuucgaaaucccgguuuugcauuagcagcagcagcaauagcauggcugcucggaucaucaacuucacaaaaaguuauauauuuaguaaugauauuacuaauagcaccagcauacagcauacgaugcauaggaguuucaaacagagauuuuguagaaggaaugucuggaggaaccuggguagacauugugcuugagcauggaggaugcguaacuguuauggcacaggacaaaccaacgguugauaucgaauuaguuacaacuacaguaucaaauauggcggagguuagauccuauuguuaugaggcaucuauaucagauauggcaucagauucgagauguccuacucaaggugaagcuuaucuagacaaacaaagugacacgcaauauguuuguaaaagaacuuuaguugacagaggauggggaaauggcugugguuuauuuggaaaagggaguuuaguaacaugugcaaaauuugccuguucuaaaaaaaugacaggcaaaucaauacaaccagaaaauuuagaauauagaauaauguuaucaguacauggaagucaacauagcggaaugauaguuaaugauacaggacacgaaaccgaugaaaaccgugcuaaaguugaaauaacaccaaauucaccaagagcagaagcaacauuaggaggauucggauccuuaggacuugacugugaaccaagaacaggacuagacuuuagugacuuauauuauuugacaaugaauaauaaacauugguuaguacauaaagaaugguuucacgauauaccauuaccuuggcacgcaggagcagauacaggcacaccacauuggaauaacaaagaagcuuuaguagaauucaaagacgcacacgcaaaacgacaaacuguugucguacuaggaucacaagagggugcaguacacacagcgcuagcuggagcauuagaagcagaaauggacggagcuaaaggacgcuuaucaucagggcaccuaaaaugucgacuaaaaauggauaaacuaagguuaaaaggaguauccuauucccuauguacagcagcauucacauucacaaaaauaccagcagaaacauuacacggaacaguuacuguggaaguacaauaugcaggaacagauggaccauguaaaguuccagcucaaauggccguagacaugcaaacguuaacaccaguaggaagacuuauuacagcgaacccaguuauaacagaaaguacugaaaauaguaaaaugauguuggaauuagauccuccauuuggagauucuuauauaguaaucggcguaggggaaaaaaagauaacacaucauuggcacagaagcggaucuacaaucggaaaagcauuugaagcaacaguaagaggcgcaaaaagaauggcaguacuaggagauaccgcaugggauuuugguaguguaggaggagcacuaaauagccuaggaaaaggaauacaccaaauauucggggcagcauucaaaagcuuauuugguggaaugucaugguucagccaaauacuaauaggaacauuauuaauguggcuuggacucaacaccaaaaauggaucuauuagccuaaugugcuuagcguuaggaggaguacuaauauucuuaucaacagcaguaagugcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4754 - RNA, 2323 nt, Artificial Sequence
  ZIKV prME variant mRNA Design 1 opt
gggagaaagcuuaccaugcgaggauuaucaucaaggaaacgaagaagccaugacgucuuaacuguacaauucuuaauacuaggaaugcuauuaaugacaggcgguguaacaagaagaggaagugcauacuacauguaucuugacagaaacgaugcgggugaagccauaagcuuuccaacaaccuuaggaaugaauaaauguuacauacaaauuauggacuuagggcauaugugcgaugcaacaaugaguuaugaauguccuaugcuagaugagggaguagaaccugacgauguagacuguuggugcaacacaacaucaacuugggucguuuaugggacuugucaccauaaaaaaggugaggcaagaagaaguagaagagcaguaacauuaccuucacauuccacaagaaaauugcaaacacgaucacaaacaugguuagaaaguagagaauacacaaaacaccuuauaagagucgaaaauuggauauuucgaaauccaggcuuugccuuggcugcugcagcaauugccuggcuauuagguaguucuacuagucaaaaagugauauauuuagugaugauuuuauugauagcaccggcauauagcauaagauguauuggcguaaguaauagagauuuuguugaagguaugaguggugguaccuggguagauauaguccuagaacauggaggauguguaacaguaauggcacaagauaaaccaacaguagauaucgaacuaguaacuacaacugucucaaacauggcagagguuagaaguuauuguuacgaagcaaguauaagugauauggcaagcgauucucgauguccaacacaaggugaagcuuacuuagauaaacaaucagauacacaauauguauguaaaagaacacuaguugacagaggaugggguaauggauguggacuauuuggaaaaggauccuuagucacuugcgcuaaauuugccuguagcaaaaaaaugacggguaaaucaauacaacccgaaaauuuagaauaccgaauuauguugaguguucauggaucucaacauucagguaugauuguaaaugauacaggacaugaaacagaugaaaaccgagcaaaaguagaaaucacuccaaacagcccuagagcagaggcaacccuuggaggauucggaaguuuaggccuagauugugaaccaagaacaggauuagauuuuagugacuuauacuaccuaacaaugaauaauaaacauugguuaguacauaaagaaugguuucaugauauacccuuaccuuggcaugcuggagcagacacaggaacgccacauuggaauaacaaagaagcacuaguugaauuuaaagaugcacaugcaaaaagacaaacaguaguaguauuaggaagucaagagggagcagugcacacagcuuuagcaggcgcacuagaagcugaaauggacggugcaaaagguagacuaucaaguggacacuuaaaauguagacuaaaaauggacaaauuaagauuaaaaggggugucauauucuuuauguacagcugcauuuacauucacuaaaauuccagcagaaacacuacauggaacaguaacaguggaaguacaauaugcaggaacagauggaccaugcaaagugccugcacaaauggcaguagauaugcaaaccuuaaccccaguaggaagauuaauaacggcaaacccgguaauaaccgaaucaacugaaaacaguaaaaugauguuggaacuagauccaccauuuggagauucauauauaguuauaggagugggagaaaaaaaaauaacccaucauuggcauagaaguggaagcacaauaggaaaggcauucgaagcuacagucagaggagcaaaaagaauggcuguucuuggagauacagcaugggauuuugguaguguugguggagcuuuaaauagccuuggaaaaggaauucaucaaauauuuggagcagcauucaaaagcuuauuuggaggaaugucuugguuuucacaaauauugauaggaacacuuuuaaugugguuaggauugaacacaaagaacggaaguauaucuuuaauguguuuagcauuaggugguguucuaauuuuucuaucaaccgcaguaagugcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4755 - RNA, 2323 nt, Artificial Sequence
  ZIKV prME variant mRNA Design 1 opt
gggagaaagcuuaccaugagaggauugaguaguagaaaacgacgaagucacgauguucuaacaguacaauuucuaauuuuagguaugcuauugaugacaggagcaguaacaagacgaggaucagcauauuauauguauuuagauagaaaugaugcaggagaagcaauaaguuuuccaacuacuuuaggaaugaacaaauguuauauucaaauaauggauuuaggccauaugugugaugcuacaaugaguuaugaaugcccaauguuagacgaaggaguagaaccagacgacguagauuguugguguaauacaacaucaacauggguaguguauggcacaugucaucacaagaaaggagaagcgagaagaaguagacgagcaguuacacuaccaagucauagcacgagaaaauuacaaacaagaucacagaccugguuagaaucaagagaauacacuaaacaccugauaagaguagaaaauuggauuuuuagaaaucccggauuugcacuagcagcugcagcuauagcuuggcuauuagguaguuccacuagccaaaaaguaauuuaccuaguaaugauauuacuaauagcaccagcauauaguauaagaugcauaggagugucaaauagagauuuuguagaaggaaugagcggugguacauggguggauauagucuuagaacauggaggauguguaaccguaauggcacaagacaaaccaacaguugauaucgaacuuguaacaacaacgguaucaaauauggcugaaguaagaucauacuguuaugaagcaaguauaucagauauggcaagugacucaagaugcccaacacaaggagaagcauaucuagauaaacaaucagacacacaauaugugugcaaaagaacauuaguagacagaggauggggaaauggauguggacuauucggaaaagggagcuuaguaacaugcgcuaaauucgcgugcaguaagaaaaugacaggaaaaaguauacaaccagaaaauuuagaauauagaauaaugcuaucaguacacggaucgcaacauucagguaugauaguaaacgauacaggacaugaaacagaugaaaaccgagcuaaaguggaaauaacgccaaauucacccagagccgaagcaacauuaggggguuucggaaguuugggauuggauugcgaaccuagaacgggguuagauuuuucagauuuauauuaccuaacaaugaauaauaaacauuggcucguacacaaagaaugguuucaugauauaccuuuaccauggcaugcaggagccgauacugguacuccacauuggaauaauaaagaagcccuaguagaauuuaaggaugcucacgcaaaaagacaaacaguugugguucuaggaagucaagaaggagcgguacauacagcauuagcaggcgcauuagaagcugaaauggauggagcgaaaggucgacugaguucaggacaucuaaaauguagauuaaagauggauaaacuaagacuaaaaggaguaucauauucauuauguacugcagcuuuuacguuuaccaagauuccagcagaaacacuacauggaacuguuacaguagaaguucaauaugcuggaacagacggaccaugcaaaguacccgcacagauggcuguagacaugcagacauuaaccccaguaggacgacuaauaacggcuaacccagucaucacugaaucaacugaaaauucgaaaaugaugcuagaacuagacccaccuuuuggagacaguuauauaguuauuggaguuggagaaaagaaaauaacacaucacuggcauagaagcggaaguacaauagguaaagcauuugaagcaacaguacgcggugcaaaaagaauggcaguuuuaggagauacugcaugggauuucggaucuguagguggagcacuaaacucucuuggaaaagguauucaucaaauauuuggagccgcuuuuaaaaguuuguuuggaggaaugagcugguuuucacagauauuaaucggaaccuuacuaauguggcuaggucuaaauaccaaaaauggaucaauaaguuuaauguguuuagcacuuggaggaguauuaauauuccugagcacagcaguaagugcggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4756 - RNA, 2329 nt, Artificial Sequence
  ZIKV prME variant mRNA Design 1 opt
gggagaaagcuuaccaugcgaauaauaaacgccagaaaagaaaaaaagagaagaggggcagauacaucuguggguaucguaggauuauuacuuacaaccgcuauggcggcggaaguaacaagaagaggaucagccuacuauauguaccuagacagaaaugaugcuggugaagcaauaucuuucccuacaacuuuaggaaugaauaaauguuacauccaaauaauggacuuaggacauaugugcgaugcaacuaugucguaugaauguccuauguuagaugaaggaguagaaccggaugacguugauugcugguguaacacaacaagcaccuggguaguauacgggacaugccaucauaaaaaaggggaagcaagacgaagccgaagagcuguuacuuuaccaagucauucaacgagaaaacuucaaacgagaucucaaacauggcuugaauccagagaauauacaaaacauuuaaucaggguagaaaacuggauuuuuagaaauccaggauucgcauuagcagccgcggcgauagcauggcugcuagggucaagcacaucucaaaaaguaauauaucuaguaaugauacuauuaauagccccagcauauucaauaagauguauaggaguaaguaacagagauuuuguagaaggaaugucugguggaaccuggguagauauaguauuagaacauggaggauguguaacugucauggcacaagauaaacccaccguagacauagaacugguaacaacaacaguaucaaauauggcugaaguacguaguuauugcuaugaagcaucaauaucagauauggccucagauucacgauguccuacccaaggagaagccuacuuagauaaacaauccgacacacaauacguguguaaaagaacauuagucgauagaggcuggggaaauggcuguggauuauuuggaaaaggaucacuaguaacaugugcaaaauucgcgugcucaaaaaaaaugacaggaaaauccauucaaccugaaaacuuagaauauagaauuauguuaaguguacacgggucacaacauagcggaaugauaguaaacgacacaggacaugaaacagacgagaacagagccaaaguagaaauaacaccaaauagcccaagagcugaagcaacacuagguggauucggaaguuuaggauuagacugugagccacgaacugguuuagacuucagcgaucuguacuauuuaacaaugaacaauaaacacuggcuaguacauaaagaaugguuccaugauauaccauugccauggcaugcaggagcagauacaggaacaccacauuggaauaauaaagaagcauuaguagaauuuaaagaugcacacgcaaaaagacagacgguaguaguuuuaggaucacaagaaggagcuguccauacagcucucgcgggcgcacuugaagcugaaauggacggagcgaaaggcagacuaucauccggucacuuaaaauguagacuaaaaauggauaaacuaagacuuaaaggaguaucauauucauuauguacugcugcauuuacauuuacuaaaauaccagcagaaacacuucauggaacgguaacuguagaaguacaauaugcugggacagauggaccaugcaaaguaccagcacaaauggcaguugacaugcaaacauugacaccaguuggaagauuaauuacagcaaauccuguaauaacagaaagcacagagaauucaaaaaugauguuagaauuagauccaccguucggagauagcuauauaguaauuggaguaggagaaaaaaaaauaacacaucauuggcacagaucaggaucaacuauaggcaaagcuuuugaagcaacaguuaggggcgcaaaaaggauggcaguauuaggagauacagcaugggacuuuggaagcguaggaggugccuuaaauagucuuggaaaaggaauacaucaaauuuuuggagcagcauuuaaaagucuauuugguggaaugaguugguuuagucaaauucuaauaggaacucuauuaauguggcuaggacuaaauacaaaaaacgggucaauaucauugaugugucuugcauuaggaggagugcuaauauucuuaaguacagccguaagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4757 - RNA, 2323 nt, Artificial Sequence
  ZIKV prME variant mRNA Design 1 opt
gggagaaagcuuaccaugauaaacgcaagaaaggaaaaaaaaagaagaggugccgauacaucaguaggaauuguugguuuguuguuaacaacagcaauggcagcagaaguuacgagaagaggaucagcauacuacauguaucuugaccgaaacgaugcaggcgaagcaauaagcuuucccacaacauuaggaaugaauaaauguuauauucagauaauggauuuaggacauaugugcgaugcuacgaugaguuaugaaugucccaugcuagaugaaggaguugaaccagaugauguggauuguugguguaauacaacaucuacguggguaguauacggaacaugccaucauaaaaaaggcgaagcaagaagaucaagacgagcgguaacauuaccuucacauucaacuagaaaacuccaaacgagaagccagacauggcuggaaucaagagaauauacaaaacaucuuauuagaguagaaaacuggauauuucgaaauccagguuucgcuuuagcagcagcagcaauagcauggcuacuaggaucuucuacaucacaaaaaguaauauauuuaguaaugauuuuguuaauagcaccagcauacaguauaagguguauagguguaaguaauagagacuuuguagaaggaaugagcggaggaacguggguagacauaguauuagaacauggaggauguguuacaguaauggcacaggauaaaccuaccguagacauagaauuggucacaacuacagucagcaacauggcugaaguacgaaguuauugcuaugaagcuucaauuagugauauggcaucagauagcagguguccaacacaaggugaagcauauuuagauaaacaaagcgauacacaauauguauguaaaagaacauuaguagacagaggaugggggaaugguuguggacuauuugguaaaggaagcuuaguaacaugcgcuaaauuugcaugcucaaaaaaaaugacuggcaaaagcauacaaccagaaaauuuagaguaucgaauaauguuaucagugcacggaagucaacacucaggaaugaucgugaaugacacaggccaugaaacggaugaaaacagagcaaaaguagaaauaacuccaaacucaccaagagcagaagcaacacuaggaggauuuggaucauuaggacuagacugcgaaccuagaacaggacuagauuucucagauuuauacuaucuuacaaugaauaacaaacauugguuaguccauaaagaaugguuucaugauauuccauuaccauggcaugcaggagcugauacaggaacgccccauuggaauaauaaggaagcuuuaguagaauuuaaagaugcacacgcaaaaagacaaacaguaguuguauuagggagucaagagggugcaguacacacagcauuagcuggugcgcuagaagcagaaauggacggggcaaaaggaagacuuaguucuggacauuuaaaaugcagacuaaaaauggauaaauuaagauuaaaaggcguaaguuauaguuuaugcacugcugcauucacauuuacaaaaauaccagcagaaacauuacauggaacgguaacaguagaaguacaauaugcaggaacugauggaccaugcaaagugcccgcacaaauggcaguggauaugcaaacgcucacaccaguaggaagauuaauaacagcuaauccagucauaacagaaucaacugaaaauucaaagaugauguuagaauuagacccaccuuuuggagauucauacauuguaauaggaguaggagaaaaaaaaauaacacaucauuggcauagaaguggaucaacaauaggaaaagcauuugaagcaacaguacgaggggccaaaagaauggcaguacuaggagauacagcaugggacuuuggaucgguagggggagcucuaaauuccuuaggaaaaggcauacaucaaauauuuggagcggcguucaaaucuuuauuuggcgguaugucuugguucucucaaauuuuaauaggaacccuucuaaugugguuagguuuaaauacuaaaaauggaucuaucagcuuaaugugcuuagcccuaggagguguauuaauuuuuuuaucaacagcaguuucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4758 - RNA, 2326 nt, Artificial Sequence
  ZIKV prME variant mRNA Design 1 opt
gggagaaagcuuaccaugauaauaaaugcuaggaaagaaaaaaaaagacggggagcagauacaaguguaggaauaguaggauuacuacuaacaaccgccauggcagcagaagucacaagaagagguucagcauacuauauguacuuagacaggaacgaugcaggagaagccauuaguuuuccgacaacacuagguaugaacaaauguuauauacaaauaauggauuuaggacauaugugcgaugcaacaaugucauaugaaugcccaauguuagacgaaggaguagaaccagaugaugucgauuguuggugcaauacaacaucaacauggguaguauacgguacgugucaucacaaaaaaggcgaagcacguagaagucgaagagcaguaacucuaccaagccauaguacaagaaaacuacaaacucgaucacaaacgugguuagaaagcagggaauauacuaaacacuuaauaagaguagaaaacuggauauuucgaaauccagguuuugcuuuagcugcagcagcaauagcauggcuauuagggucauccacgucacaaaaaguaauauauuuaguaaugauauuacuaauagcaccagcguacuccauaagauguauaggaguuagcaauagagacuucguugaaggaaugucugguggaacauggguugauauaguccuugaacacggaggauguguaacggucauggcacaagauaaaccaacuguugauauagaacuaguaaccacaacaguaagcaauauggcagaagucagaucauauuguuacgaagccaguauaagcgauauggcaucagauucaagauguccaacucagggugaagcauauuuggauaaacaaucagauacacaauaugucugcaaacgcaccuuaguagauagagggugggguaaugguuguggacuauuuggaaaaggaucacuaguaacaugcgcaaaauucgcauguucaaaaaaaaugacagggaaauccauacaaccagaaaauuuagaauacagaauaaugcuaucaguccauggaucacaacauagugguaugauuguuaaugauacaggucacgaaacagaugaaaauagagcaaaaguagaaauaacaccaaauaguccaagagcagaagcaacauugggaggauuuggaucucuaggucuagauugugaaccuagaacaggacuggacuuuagugaccuuuauuacuuaacaaugaacaauaaacauuggcuaguacauaaagagugguuccaugauauaccacuaccauggcaugccggagcagauacaggaacuccccacuggaauaauaaagaagcucuaguagaauuuaaagacgcacaugccaaaagacaaacaguagucguauuaggaucccaagaaggagccguacauacagcacuagccggagcauuagaagcagaaauggauggagcaaaaggacgacugagcucaggucaucuaaaauguagauuaaaaauggacaaauuaagauuaaaaggggugucauacagucuauguacagccgcauuuacuuucacaaaaauaccagcugaaacauuacacggcacagugaccguugaaguacaauaugcaggaacagaugguccaugcaaaguacccgcacaaauggcagucgauaugcaaacauuaacaccaguaggaagauuaaucacagcaaauccaguaauaacagaaaguaccgaaaauucaaaaaugauguuggaauuagauccaccauuuggagauaguuauauaguaauaggaguuggagaaaaaaaaaucacccaccacuggcacagaaguggcaguacaauagguaaagcguucgaagcaacugucagaggagcaaaaagaauggccguacuuggagacacagcaugggauuuuggaucaguuggcggcgcucugaacucccuaggaaaaggaauccaucaaauauuuggagcagcauuuaaaaguuuauuuggagguaugaguugguucucacaaauacuaauuggaacacuucuaauguggcuaggacuaaauacaaagaacggcaguauaucauugauguguuuagcgcuaggaggcguacuaaucuuucuaagcacagcgguuucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4759 - RNA, 2320 nt, Artificial Sequence
  ZIKV prME variant mRNA Design 1 opt
gggagaaagcuuaccaugaaugcaagaaaagaaaagaaaagaagaggugccgauacauccguagguauaguuggcuuauuauuaacaacagccauggcagcugaagugacuagaagagguucagcauauuacauguaucuagauagaaaugacgcaggagaagcaauaaguuuucccacuacauuaggaaugaauaaauguuauauacaaauaauggaucuuggacacaugugcgaugcuacaaugaguuaugaauguccaauguuagaugaaggaguggaaccagaugauguagauuguugguguaacacgacaucaacuuggguaguuuauggaacaugucaucauaagaaaggagaagcaagacgaucaagacgagcaguaacacucccaagccacucuacaagaaaauuacagacaagaucacaaacaugguuagaaucccgagaauacacaaaacaccuaauuagaguagagaacuggauuuuuaggaauccaggauuugcauuagcggccgcugcaauagcauggcuacuaggaucaaguacaagucaaaaagucaucuauuuaguaaugauauuauuaauagccccugcauacucaauaagauguauuggcguaaguaauagagacuuuguagaagggaugaguggaggaacuuggguagauauaguauuagagcauggaggauguguaacaguaauggcacaagacaaaccaacuguagauauugaguuaguaacaacaacugugaguaacauggcagaaguaagauccuauugcuacgaagcauccauuucagauauggcuucagauaguagauguccaacucaaggagaagccuaucuagacaaacaaagugacacacaauauguuuguaaaagaacauuaguagauagaggaugggguaauggauguggcuuauucggaaaagguucauuaguuacaugcgcaaaauuugcuuguucaaagaaaaugaccggcaaaucaauucaacccgaaaauuuagaauauagaauaaugcucaguguacacggaagccaacauucagguaugauaguaaacgauacugggcaugaaacagacgaaaauagagcuaaaguagaaauuacaccaaauuccccaagagcagaagcuacauugggaggauuugggagucuaggacuugauugugaaccaagaacaggucuagacuucagugaucuguacuaucuuacaaugaauaacaaacauuggcuuguccauaaagaaugguuucacgacauaccacuaccauggcaugcaggagcagauacuggaacgccacacuggaauaacaaagaagcauuaguugaauuuaaagaugcacaugcgaaaagacaaacaguaguaguuuuagguagccaagaaggagcuguacauacagcauuagcaggagcauuagaagcagaaauggauggagcgaaagguagauuaucaucaggacaucuaaaaugucgacuaaaaauggauaaauuaagacucaaaggaguuucauacucauuauguacagcagccuuuacuuucaccaaaauaccagcagaaacacugcauggaacuguaacaguugaaguacaauacgcaggaacagauggaccauguaaaguaccagcgcagauggcaguagauaugcaaacacucacaccuguagguagacuaaucacagcaaauccgguaauaacagaaaguacagaaaauucuaaaaugaugcuagaacuagauccgccauucggagacagcuacauaguaauaggaguuggugagaagaaaauaacacaccauuggcacagaucaggaaguacaauaggaaaagcauuugaagcaaccguaagaggagccaaaaggauggcagucuuaggagauacagcaugggauuuuggaaguguagggggugccuuaaauuccuuggguaaagguauacaucaaauuuuuggagcagcauuuaaaucauuauuuggcggcauguccugguucucacaaauacugauaggaacucuauuaauguggcuuggcuuaaauacgaaaaauggaaguauaucauugaugugccuagcauuaggcggaguucuaauauuuuuaaguacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4760 - RNA, 2317 nt, Artificial Sequence
  ZIKV prME variant mRNA Design 1 opt
gggagaaagcuuaccauggcaagaaaagaaaagaaaagaagaggagcggacacaagugugggaauaguaggacuauuauuaacaacagcuauggcagcagagguaacgaggagaggaucagcauauuauauguaucuagaccgaaaugaugcaggagaagcuauuucauucccaacgacucuaggaaugaacaaaugcuacauacaaauaauggacuuaggacauaugugugacgccacaaugaguuaugaaugcccaaugcuagaugaaggcguagaaccagaugacguagauuguuggugcaauacaaccucgaccuggguagucuacggaacaugucaccauaagaaaggagaagcaagaaggucaagacgagccgucacuuuaccuagccauucaacacgaaaacuacaaacaagaucacaaacauggcuagaaaguagagaauauaccaaacauuuaauaagaguagaaaauuggauauucagaaacccaggauucgcauuagcugcagcagcuauagcuuggcuauuaggcagcucaacaagucaaaaagugauauaucugguaaugauacuacuuauagcuccugcauacucaauuagauguauaggcguaucaaauagagauuuuguugaaggaaugagcggaggaacauggguagacauaguauuagaacacgguggaugugugacaguuauggcacaagauaaaccaacaguagauauugagcuaguuacuacaacaguaucaaacauggccgaaguaagaaguuacugcuacgaagcaucaauaagugauauggcaucagauagcagauguccaacccaaggugaagcauauuuagauaaacaaucagauacucaauauguuuguaaaagaaccuuaguagauagaggauggggaaauggauguggguuauuuggaaaaggaaguuuaguaacaugcgcuaaauuugccuguucgaagaaaaugacaggaaaaucuauucaaccagaaaaucuagaauaccgaauaaugcuuagcgugcauggaagucaacacagcggaaugauagucaacgauacuggacaugaaacggaugaaaacagagcaaaaguugaaauaacaccgaauagucccagagcagaggcaacauuaggaggauuugguuccuuaggacuagacugcgagccaagaacaggccuagauuucagcgauuuauauuaucuaacuaugaacaauaaacacugguugguccauaaagaaugguuucaugauauacccuuaccuuggcaugcuggugcagauacaggaacaccacauuggaauaauaaagaagcacuuguagaauuuaaagaugcacaugcaaaaagacaaacaguaguagucuuaggaucucaagagggagcaguacacacggcacuugcuggggcauuagaagcagaaauggauggagcuaaaggucgauuaaguaguggacacuuaaaaugccgauuaaaaauggacaaauuaagauuaaaaggaguaucauauucacuaugcacagcugcuuucacauuuacaaaaauaccagcugaaacacuacauggaacaguaacaguagaaguacaauacgcaggaacagauggaccguguaaaguaccagcacaaauggcaguggauaugcaaacacuuacgccaguaggaagauuaauaacagcuaaucccguaauuacugaaaguacagaaaauucuaaaaugaugcuagaacuagacccaccuuucggugauaguuauauaguaauaggaguaggagaaaagaaaaucacacaucauuggcaucgaucaggaaguacaauaggaaaagcauuugaagcuacaguaagaggcgcuaaacgaauggcaguucugggagauacugcaugggauuuuggaaguguaggaggagcacuaaacucauuaggaaaaggcauccaccaaauauuuggagcugcauuuaaaagucuauucggagguaugucaugguucagucaaauauuaauaggaacguuauugaugugguuaggcuuaaauacuaaaaacgguucaauuucacuaaugugucuagcacuaggaggaguauuaauauucuuaaguacggcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4761 - RNA, 2314 nt, Artificial Sequence
  ZIKV prME variant mRNA Design 1 opt
gggagaaagcuuaccaugcggaaagaaaaaaaaagaagaggugcugauacaaguguaggaaucguaggacuauuauuaacaacagccauggcagccgaaguaacaaggagaggcuccgcauauuauauguaucuagaucgaaacgaugcuggugaagcaauaucuuuuccaacaacacuaggaaugaauaaauguuauauacaaauuauggaucuagggcauaugugcgaugcaacuaugaguuaugaaugcccaauguuagacgaggguguagaacccgaugauguugauuguugguguaauacaacaagcacauggguaguauauggaacaugccaccacaaaaaaggugaggcaagaagaagccgaagagcuguaacauuaccaucacauagcacuagaaaauuacaaacgagaagccaaacaugguuagaaucaagagaguacacuaagcaucuaauuagaguagaaaacuggauauuuagaaauccaggauucgcacuugcagcagcggcaauagcauggcuauuaggaucaucaacaagucaaaaaguaauauauuuaguuaugauacuuuuaauagcacccgcauauagcaucagaugcauuggaguaucaaauagagacuuugucgaagguaugucuggagguaccuggguagauauaguauuagaacaugguggauguguaacgguaauggcacaagacaaaccaacuguggauauagaacuaguaacuacaacaguaaguaauauggcagagguaagaucuuacugcuaugaagcaucaauaucagacauggcaagcgacucaagaugcccgacacaaggagaagccuauuuagauaaacaaucggacacgcaauauguuuguaaacgcacuuuaguagauagaggaugggguaauggaugugguuuauuuggaaaaggaagcuuaguuacaugugcuaaauucgcauguucaaaaaaaaugacaggaaaaucaauacaacccgaaaacuuggaauaucgaauaauguuaagcguacaugguucacaacacucagguaugauugucaaugacacaggucaugaaacagacgaaaacagagcaaaaguagaaauaacgccaaacucaccuagagcugaagcaacacuaggugguuuuggaucucugggacuagauugcgaaccaagaacaggacucgauuucagugauuuauauuacuuaacuaugaauaauaaacacuggcuaguccacaaagaaugguuucaugauauaccacugccauggcacgcaggugcagauaccgguacaccccauuggaauaacaaagaagcacuaguggaauuuaaagaugcacaugccaaacgucaaacagugguaguuuuaggaagucaagaaggagcaguccauacggcucuagcaggugcacuagaggcagaaauggauggggcuaaaggaagauuaucaaguggacauuuaaaguguagacuaaaaauggauaaauugagauuaaaagggguaaguuacucauuaugcacagcugcauuuacauucacaaaaauuccagcagaaacacuacauggcacaguaacaguagaaguccaauacgcaggaaccgaugguccguguaagguaccugcacaaauggcaguagacaugcaaacauuaacaccagucggccgacuaauaaccgcaaauccaguaauuacagaaaguacagaaaauaguaaaaugauguuagaauuagauccaccauuuggagauuccuacauuguuauaggaguaggugagaaaaaaauaacgcaucauuggcacagaaguggaaguacuauaggcaaagccuuugaagcuacaguaagaggggcgaaaagaauggcaguauuaggagauacagcuugggauuuuggaagugucggcggcgcacuuaauaguuuaggcaaagguauucaccaaauauuuggagcggcauucaaaucacuauucggaggaaugucuugguuuucucaaauauuaauaggaacauuacuaaugugguuaggacuaaauaccaaaaauggcuccauaucacucauguguuuagcauuaggagggguacuaauauucuuaagcacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4762 - RNA, 2311 nt, Artificial Sequence
  ZIKV prME variant mRNA Design 1 opt
gggagaaagcuuaccaugaaagaaaaaaaaagaagaggagcagauacaaguguagguauaguaggauuguuacuaacaacagcuauggcagcagaaguaacaagaagaggaagugcauauuauauguaccuagauagaaaugaugcaggugaagcaauaaguuuuccaacaacauugggaaugaauaaauguuauauacaaauaauggauuuaggacauaugugugacgcuaccaugucauacgaauguccaaugcuagaugaaggaguagaaccagaugauguagacuguugguguaacacuacuucaacauggguaguauauggaacaugccaucauaaaaaaggagaagcaagaagaucaagaagagcaguaacacuaccaucacauucuacaagaaaauuacaaacacgaagccaaacauggcuugaaucacgagaauauacaaaacaucuaauacguguagaaaacuggauauuuagaaacccgggauucgcuuuagcagccgcugcaauagcauggcugcuagguucaucaaccucacaaaaagucauauaucuaguuaugauacuacuaauagcucccgcauacucaaucagauguauaggaguaagcaauagagauuuuguugaaggaaugucaggagguacauggguagauauaguguuagaacauggaggauguguaacaguaauggcgcaagauaaaccaacaguagauauagaauuaguaacaacuacaguaaguaacauggcugagguuagaaguuacuguuacgaggcgucuauaagcgauauggcaucagacaguagauguccaacccaaggugaagcauauuuagauaagcagagugacacacaauauguaugcaaaagaacguuaguugaucgaggauggggaaauggauguggauuauuugguaaaggaagucuaguaacaugugccaaauuugcauguaguaaaaaaaugacaggaaaaagcauacaaccugaaaaucuagaauauaggauaauguuaaguguacauggaagccaacacucuggcaugauuguaaaugacacaggucaugaaacggacgagaacagagcgaaaguagaaauaaccccgaauagccccagagcugaagcaacauuagggggauuugguagucuagguuuagauugugaaccaagaacaggguuagauuuuagugauuuauauuacuugacaaugaacaacaaacauuggcuaguacacaaagaaugguuucacgauauaccacuacccuggcaugcuggagcggacacagguacaccccacuggaauaauaaagaagcucuagucgaauuuaaagaugcacaugcaaaaagacaaacaguaguaguuuuaggaucacaagaaggagcaguacauacggcacuagcaggagcguuagaagcagaaauggauggggcuaaagggcgauuaucaucaggacacuuaaaaugucgauuaaaaauggauaaacuaagauuaaaaggaguaucauauaguuuaugcacagcagcauuuacuuuuacaaaaauaccagccgaaacacuucaugguacuguaacaguggaaguccaguaugcuggaaccgauggaccauguaaagugccagcgcaaauggcaguagauaugcaaacauuaaccccgguaggcagacuuauaacugccaacccuguaauaacagaaucaacggaaaacucaaaaaugaugcuugaauuagauccgccauuuggagacagcuacauuguaauagguguaggagaaaaaaaaauaacacaccacuggcauaggucaggaucgaccauugguaaagcguuugaagcaacaguacgaggagcuaaaagaauggcaguacuuggagacacagcuugggauuuugguucuguaggaggugcauuaaacagccuaggaaaaggaauacaucaaauauuuggagcagcuuuuaaaagucuauuugguggaaugaguugguuuagccaaauauuaauuggaacguuauuaaugugguuaggguuaaauacaaagaacgguaguauuagucuuaugugcuuagcuuuaggaggaguacuaauauuuuuaagcacagccguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4763 - RNA, 2308 nt, Artificial Sequence
  ZIKV prME variant mRNA Design 1 opt
gggagaaagcuuaccauggaaaagaaaagaagaggggcggauacauccguaggaauaguuggacuauuauuaacaacugcaauggccgcagaaguaacacguagaggaucagcuuauuauauguaucuagauagaaacgaugcaggagaagcuauaaguuuuccaacaacacuaggaaugaauaaauguuauauacaaauaauggaccucggccacaugugugacgcuacaaugucuuaugaaugucccauguuagaugaaggagucgaaccagaugacguagauugcugguguaauacaacaucuacuuggguaguauaugguacaugucaucacaagaaaggugaagcaagaagaucacgaagggcaguaacuuuaccaucucacagcacuagaaaauuacaaacuagaagccaaacaugguuagaaucuagagaauauacaaaacauuuaauacgaguagaaaauuggauauuuagaaacccugguuuugccuuggcagccgccgcuauagcaugguuacuaggaucaucaacaagccaaaaaguaauauaccuaguuaugauacuacuaauugcaccagcauauucaauuagguguauaggaguuagcaauagagauuuuguagaagguaugucagguggaacauggguagacauuguauuagaacacggagguugugugacuguaauggcgcaagauaaaccaacaguagacauagaauuaguaacuacaacuguaaguaacauggcagagguaagaucguauugcuaugaagcaaguauaagugacauggcuucagauucaagauguccaacacaaggugaggcauaucuagacaaacaaucagacacacaauacguauguaaaagaacuuuaguagaccgcggcuggggaaacggaugcggacuauuugguaaaggaaguuuaguaacaugcgcaaaauucgcauguucuaagaaaaugacaggaaaaucaauacaaccugaaaaucuagaauauagaauaaugcuaaguguacauggaagucaacauucaggaaugauugugaacgacacuggacaugaaaccgaugaaaauagagcaaaaguagaaauaacaccaaauucgccaagagcagaagcaacucuuggggguuuuggaucauugggauuagauugcgagccuagaacaggauuagauuucagcgaucuuuauuacuugacaaugaauaauaaacauugguuaguacauaaagaaugguuccaugauauaccacuaccauggcaugcgggagcagauacugguacaccucauuggaacaauaaagaagcacugguagaguucaaagaugcccaugcaaaacgacaaacaguaguaguauuagggucacaagaaggagccguucacacagcacucgcuggcgcauuagaagccgaaauggauggcgcaaaaggaagauugucuucaggacaucuaaaaugccgauuaaaaauggacaaauuaagacuaaaagggguaagcuauucauuauguacagcggcauuuacauuuacaaaaauaccugcagaaacucuacauggaacaguaacaguggaaguacaauaugcagguacugacgguccuuguaaaguaccagcacaaauggcaguagacaugcaaacuuuaacaccaguagggagauuaauuacugcgaauccaguuauaacagaaaguacagaaaauucaaaaaugauguuagaauuagauccaccauucggagauagcuauauaguaauagguguaggagaaaagaaaauaacucaucacuggcacagaaguggauccacaauaggaaaagcauucgaagcaacaguaagaggcgcaaaaagaauggcaguauuaggcgacacugcaugggauuuugggucaguaggaggagcauugaauagucucgguaaagguauccaucaaauauuuggagccgccuuuaaaaguuuauucggaggaaugucuugguuuucucaaaucuuaauagguacacuacuaauguggcucggacuaaauacgaaaaauggcucgauaucacuaauguguuuagcucuaggagguguacuaauauuuuuaucaacagcagugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4764 - RNA, 2305 nt, Artificial Sequence
  ZIKV prME variant mRNA Design 1 opt
gggagaaagcuuaccaugaagaaaagaaggggagcagauacaaguguaggaauaguaggacuauuacugacaacagcaauggccgcggaaguaacaagaagaggaucagcuuacuacauguacuuagaccgaaaugaugcaggagaagcaauaucguuuccaaccacauuaggaaugaauaaauguuauauacaaauaauggauuuaggacauaugugugacgcaacaaugagcuaugaaugcccaaugcuagaugaaggagucgaaccugaugauguagauuguuggugcaacacaacuagcacuuggguaguauacggaacaugucaccauaagaaaggugaagcuagacgaaguaggagagcuguaacauuacccagucauagcacaagaaaauuacagacaagaagccaaacaugguuagaaucaagagaauacacaaaacaccuaauaagaguagaaaauuggauauuuagaaauccaggcuucgcucuggcagcagcagcgauagccuggcuacuaggaaguucgacaagucaaaaaguaauauauuuaguuaugauuuuacugauugcuccagcauauaguauaagauguauaggagucaguaaccgagauuuuguagaaggcaugucaggaggaacauggguagauauuguauuagaacauggagguugugucacaguaauggcacaagacaaaccaacaguagauauagaauuaguaacaacuacaguaaguaauauggcagagguaagaucauauuguuaugaagcauccauaagugauauggcaucagauucaagauguccuacucagggagaagcauauuuagauaaacaaagugauacacaauauguauguaaaaggacauuaguagaccguggauggggaaauggauguggacuauuuggaaaaggaucauuaguuacaugcgcaaaauuugcauguucuaagaaaaugacagguaaaagcauacaaccagaaaauuuagaauaucgcauuaugcuaucaguucauggaucccaacauucagguaugaucgugaacgauacagggcaugaaacagaugaaaauagagcaaaaguagaaauaacaccaaacagcccaagagcagaagcaacuuuaggcggcuuuggaaguuuaggauuagacugugaaccaagaacagguuuagauuuuucagaucuauacuauuuaacaaugaacaauaaacauugguuaguccauaaagaaugguuucacgacauacccuuaccauggcacgcgggugcagauacagguacuccacauuggaacaacaaagaagcauuaguagaauuuaaggacgcucaugcaaaaaggcaaacugugguaguauuaggaucacaagagggagcuguucacacagcauuagcaggagcucuagaagcagagauggauggagcaaaaggaagauuaaguucgggacaucuaaaaugucgacuaaaaauggacaagcuaagauuaaaaggaguaaguuauagucuaugcacagcagcuuuuacauuuaccaaaauaccagcugaaacgcuacaugggacaguaacaguagaaguacaauaugcagguacagaugggccuuguaaaguaccagcacaaauggcaguagauaugcaaacacuaacaccaguaggacgauuaauaacagcaaauccagugauuacugaaagcacagaaaacaguaaaaugaugcuagaauuagacccacccuuuggagacaguuauauaguaauaggcguaggagaaaagaaaauaacucaucacuggcauagaaguggaagcacaauaggaaaagcauuugaagcaacaguuagaggagcaaaacgaauggcugugcuaggagauacagcuugggauuuuggcucaguaggaggggcauuaaauucauuagguaaaggaauacaucaaauauucggugcagcauuuaaaagucuauuugguggaaugaguugguuuucacaaauauuaauagguacucuacuaaugugguugggauuaaacacgaaaaacggaucaaucagucuaaugugccuagcgcuugggggcguguuaauauuuuuaaguacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4765 - RNA, 2302 nt, Artificial Sequence
  ZIKV prME variant mRNA Design 1 opt
gggagaaagcuuaccaugaaaagacguggagcugauacaagugucggcauuguaggucuguuauuaacaacagcaauggccgcagaaguaacaagaagaggaucagcauauuauauguauuuagauagaaaugaugccggagaagcaauaucuuuuccuacaacauuagggaugaauaaaugcuauauucaaauaauggauuuagggcacaugugugaugcaacgaugaguuacgaaugcccaauguuagaugaaggaguagaaccggacgauguagauuguugguguaacacuacaucaacauggguuguuuacggaacaugucaucauaagaaaggagaagcaaggagaagucgcagagcagucacauuaccuagucacucaacaagaaaauuacaaacaagaagucaaacaugguuagaaaguagagaauauaccaaacaucuaauaagagucgaaaauuggauuuuuagaaacccgggauucgcacuggcagcagcugccauugcauggcuccugggaucaaguacgucacaaaaaguaauauauuuaguaaugaucuuauuaaucgcaccggcauacucaauuagauguauaggaguaagcaacagagauuuuguagaagggaugucagguggaacauggguagauaucguauuagaacauggcgggugugucacaguaauggcacaagauaaaccuacaguugauauagaauuagugacaaccacaguuaguaauauggcagaaguacgaucauauuguuaugaggcuuccauaucagacauggcaagugacucacgaugcccaacucaaggagaagccuauuuagacaaacaaucugauacacaauacguaugcaaaaggaccuuagucgacagagguuggggaaauggaugcggacuauuugggaaagguagcuuaguaacaugugcaaaauuugcaugcucgaagaaaaugacaggaaaaagcauacaaccagaaaauuuagaauauagaauaauguuaagcguucauggaucacaacacaguggaaugauaguaaaugauacagggcaugaaacagacgaaaauagagcuaaaguagaaauaacuccaaacagcccaagagcggaagcaacauuaggaggauuuggaaguuuaggacuagauugcgaacccagaacaggacuggacuuuagcgaccuauauuauuuaacaaugaauaauaaacauuggcugguucauaaagaaugguuucaugauauuccuuuaccguggcaugccggugcagauacagguacaccacauuggaauaacaaagaagcacucguagaauuuaaagaugcacaugcaaaaagacaaacaguaguagucuuaggaucccaagaaggagcaguacacacugcucuagcgggagcccuagaagcagaaauggacggcgcuaaaggaagauuaucuucaggacaucuaaaauguagacuaaaaauggauaagcuaagauuaaaaggcguaucuuauagccuauguacugcagcuuuuacauuuacaaaaauaccagcagaaacuuuacauggaacaguaacaguagaaguacaauacgcaggaacugacggaccaugcaaaguucccgcacaaauggcagucgacaugcagacacuaacaccaguuggaagauuaauaacagcaaauccaguaauaacagaaucaacagaaaauucuaaaaugaugcuugaauuagacccgcccuucggagauucauauauaguaauugguguaggagaaaagaaaauaacccaucacuggcacagaaguggauccacaauagguaaagcauuugaagcaacaguaagaggugccaaaaggauggcaguccuaggagauacagccugggauuuuggaaguguugguggggcacuuaacaguuuaggaaaaggaauacaucaaauuuuuggagcagcauucaaaagucuauucggaggaaugaguugguuuucacaaauacuaaucggaacacuauuaaugugguuaggauuaaauacuaaaaacggaagcauaucauuaaugugucuugcauuaggcggagugcuaaucuuuuuaagcacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4766 - RNA, 2299 nt, Artificial Sequence
  ZIKV prME variant mRNA Design 1 opt
gggagaaagcuuaccaugagaaggggugcggauacaucuguaggaauaguaggauuauuauuaacaacggcaauggcagcagaaguuacaagaagaggaagugcuuacuacauguauuuagauagaaacgaugcuggugaagccauaaguuucccaacuacauuaggaaugaacaaaugcuacauccaaaucauggaccuuggacauaugugugaugcuacaaugucauacgaauguccaaugcuggaugaagguguagaacccgaugauguagacuguugguguaacacaacaucuacuuggguuguuuaugguacgugucaccauaagaaaggugaagcaagacgaucaagacgagcaguaacauuacccagucacucaaccagaaaacuacaaacaagaucacaaacaugguuagaaucaagagaauauacaaaacaucuuauaagaguagaaaacuggaucuuuagaaacccuggauuugcauuagcagcagcagcuauagcaugguuacuagguucgaguacaagucaaaaaguuauuuaucucguaaugauacuauuaauagcaccagcuuauagcauaagauguauagguguaucaaauagagauuuuguagaagggaugucaggagggacauggguagauaucguauuagaacauggaggauguguaacagucauggcgcaagacaaaccaacaguugauauagaauuaguaacaacaacaguuuccaauauggcagaaguuagaucauauuguuaugaagcuagcaucucagauauggcuuccgacucaagauguccaacacaaggagaagcauauuuagacaaacaaucugauacacaauauguauguaaaagaacucuaguagauagagguuggggaaaugguuguggauuauuuggcaaaggaucuuuaguuacaugcgcaaaauuugcauguaguaagaaaaugacaggaaaaagcauucaaccugaaaauuuagaauauagaauaaugcuaucaguacacggaagucaacauagcgguaugauaguaaacgauacaggacaugaaacagaugaaaacagagcaaaaguggaaauaacaccaaacucaccuagagcagaagcaacauuaggcggauuugguaguuuaggauuagacugugaaccaagaacaggguuagauuuuagugauuuguauuauuuaacaaugaauaacaaacauuggcuaguacauaaagaaugguuccacgauauaccauuaccguggcaugcaggggcagauacuggaacuccccauuggaacaauaaagaagccuugguagaauuuaaagacgcacaugcaaaacgacaaacagucguaguauuaggcucacaagaaggcgcaguacauaccgcuuuagcaggcgcuuuagaagcagaaauggauggagccaaaggaaggcuaucaucuggucaucuuaaauguagacuaaaaauggauaaacuaagacuaaaaggaguuucuuacagucucuguacagcagcauuuacauucacgaaaauaccagcugaaacacuacauggaacuguaacaguagaaguacaauaugcaggaaccgauggaccauguaaaguaccagcacaaauggcaguugauaugcaaacauuaaccccaguagggagacuaauaaccgcaaauccaguuauuacagaaucaacagaaaacaguaaaaugaugcuagaauuagaucccccuuuuggcgauucauacaucguaauaggugugggagaaaagaaaauaacgcaucacuggcaucgaucaggaagcacaauaggaaaagcauuugaagcuacagucagaggagcuaaaagaauggccguucuaggagacacugcuugggacuucggaucaguugguggagcauuaaauucucugggaaaaggaauacaucaaauauuuggugcagccuucaaaucacuauuugguggcaugaguugguucucacagauacuaauagguaccuuauuaauguggcuaggauuaaauacuaaaaacggaucaauaucauugaugugcuuagcccuaggaggaguuuuaauauuucuaagcacagcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4767 - RNA, 2296 nt, Artificial Sequence
  ZIKV prME variant mRNA Design 1 opt
gggagaaagcuuaccaugcgaggagccgauacaagcguuggaauaguugguuuauuauuaacaacagcuauggcagcagaaguaaccagacguggaucggcauauuauauguaccuagacaggaaugaugcaggagaagcaauaucuuuucccacaacuuuaggaaugaauaaaugcuauauacaaauaauggauuuaggacauaugugugaugcaacuaugagcuaugaaugcccuauguuggaugaagggguugaaccagaugauguagauuguuggugcaacacuacaucaaccuggguuguauauggaacaugucaucacaagaaaggagaagcucgcagaagcagacgagcaguaacacuaccuucacauagcacaagaaaacuacaaacacgaucucaaacaugguuagaaagcagagaauacacaaaacaccuaauaaggguagaaaauuggauauuuagaaacccaggguuugcauuagcagcagcggcuauagccuggcuauuaggaucuaguacaucacaaaaaguaaucuacuuagugaugauauuauuaauugcaccagcauacucaauaagauguauaggaguuagcaauagagauuucgucgaaggaaugucaggcggaacauggguagauauuguauuggaacauggaggaugcguaacaguaauggcacaagauaaaccuacuguagacauagaauuaguaacaacaacuguaagcaacauggcagaaguaaggucauauuguuacgaagcaaguauaucagauauggcaagugauucgagauguccaacacaaggcgaagcauauuuagacaaacaaucagauacacaauauguauguaaaagaacccuaguagauagaggauggggaaauggauguggucuauuuggaaaaggaaguuuaguaacaugcgcuaaauucgcaugcagcaagaaaaugacaggaaaaucuauacaaccagaaaauuuagaauacaggauaauguuaucaguccacggaagucaacauucaggaaugauagucaaugacacaggacaugaaacugacgaaaauagagcaaaaguagaaauaacaccaaacucaccaagagcagaagcaacacuagguggcuucgguucauuaggacuggacugugaaccaagaacaggauuagacuucagcgauuuauacuacuuaacuaugaauaacaaacauuggcuaguacauaaagaaugguuccaugacauaccauuaccuuggcaugcuggugcagauacuggaacaccacauuggaauaauaaagaagcgcuaguggaguucaaagaugcacaugcuaaacgacaaacaguaguaguauuaggcucacaagaaggagccguccauacagcacuugcaggagcacuugaagcagaaauggauggagcaaaaggaagauuaucgaguggccacuuaaaaugucgacuaaaaauggauaaacuaagauuaaaaggaguuucauauaguuuauguacagcagcauuuacauucaccaaaauuccagcagaaacauuacauggaaccguaacuguggaaguacaauaugcaggaacagauggacccuguaaaguaccagcacaaauggcagucgauaugcaaaccuuaacaccaguaggaagauuaaucaccgcaaacccugugauaacagaaucuacagaaaacaguaaaaugaugcuagaauuggauccuccauucggagauuccuauauaguaauaggaguaggagaaaagaaaauuacucaccacuggcacagaucagguagcaccauagguaaagcauuugaagcuacaguaagaggugcaaaaaggauggcuguauuaggcgacacagcaugggauuucggaucaguuggaggcgcuuuaaacucacucggaaaaggcauucaucaaauauuuggagcagcauuuaaaaguuuauuuggaggaaugucaugguuuucacaaauucuaauaggaacauuacuaauguggcugggucucaauaccaaaaacggcaguaucagcuugaugugucuagcauuaggaggcguacuaauauuccuaagcacagcaguaucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4768 - RNA, 2293 nt, Artificial Sequence
  ZIKV prME variant mRNA Design 1 opt
gggagaaagcuuaccaugggcgcagauacaaguguaggaauuguaggguuauuacuaacaacagcaauggcagcagaaguaacaagaagagguagugcauauuauauguaucuugauagaaacgaugcaggagaagcuauuucauuuccaacaacacuaggcaugaauaaauguuauauacaaaucauggauuuaggacacaugugcgaugcuacaaugaguuaugaauguccaaugcuagacgaaggcguugaaccagaugauguagauugcugguguaacacaacaaguacuuggguaguuuauggcaccugucaucacaagaaaggagaagcgcgaagaaguagacgagcaguaacauuaccaucacauagcacaagaaaauugcagacuagaagucaaacauggcuugaaucaagagaauauacaaaacauuuaauacgaguugaaaacuggauauuccgaaauccagguuuugcacuagcagcagcagcaauagcauggcuacugggaucaaguacuagccaaaaaguaauauauuuaguaaugauauuacuaauagcccccgcguacaguauaaggugcauagguguaucgaauagggauuuuguugaaggaaugagcggagggacuuggguggauauaguacuagaacauggagguuguguuacaguaauggcacaagauaaaccaacaguugacauagaauuagugacaacaacuguaagcaauauggcugaaguaaggagcuauugcuaugaagcaaguauaucagauauggcaagugauucaagauguccaacacaaggugaagcauacuuagauaaacaauccgauacucaauauguauguaaaagaacucuaguagaucgaggauggggaaacggauguggauuauuuggaaaagggaguuuaguaacaugcgcaaaauuugcauguaguaagaaaaugacaggaaaaucaauacagccagaaaaucuagaauaucggauaaugcuaucaguacaugguagucaacauucaggaaugauaguaaacgauacaggucacgaaacagacgaaaaucgagcaaaaguugaaauaacaccuaacaguccacgagcugaagcaacauuaggcggauuuggaucccuaggauuagacugugaaccgaggacaggacuagauuuuucagaucuauauuauuuaacaaugaacaauaaacauuggcuaguucauaaagaaugguuucaugauauaccauuaccauggcaugcuggugcagacacaggaacaccucauuggaauaauaaagaagcauuaguagaauuuaaagacgcacacgcaaaaagacaaacaguuguaguauuaggaagccaagaaggagcuguacauacagcacuugcuggagcacuagaagcugaaauggauggugcuaaaggcagauuaagcaguggucauuuaaaaugcagauugaaaauggauaaauuacgauuaaaaggaguaucauauuccuuaugcacagcagcauuuacauuuacaaaaauaccagcagaaacauuacauggaacaguaacaguagaaguccaauaugcaggaacagacggaccaugcaaaguaccagcacaaauggcaguugauaugcagacacuaacaccaguaggaagauuaauaacugcaaacccgguaauaaccgaaaguacagaaaauucaaaaaugauguuggagcuggauccaccauuuggggacucauacauaguaauuggcguaggagaaaagaaaauuacacaccacuggcaucgaaguggaagcacaauaggaaaagcauucgaagccacaguaaggggagcaaaaagaauggcaguauuaggugacacagcaugggacuucgguucaguaggaggugcuuuaaauaguuuagguaaaggaauacaccaaauauuuggagcagcauuuaaaucauuauuuggaggaaugaguugguuuucacaaauucugauaggaacguuacuaauguggcuuggcuuaaauacgaaaaauggaagcauuucauuaauguguuuagcgcuugguggaguuuuaauauuuuuaucuacugcaguuagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4769 - RNA, 2290 nt, Artificial Sequence
  ZIKV prME variant mRNA Design 1 opt
gggagaaagcuuaccauggcagauacgucugucggaauaguuggauuacuacuaacaacugcaauggccgcagaagugacuagacgagguucggcguacuacauguaucuagacagaaaugaugcuggagaagccauaucauuuccaacuacauuaggaaugaauaaaugcuacauacaaauuauggaccuaggacauaugugugacgcaacaaugucauaugaauguccaauguuagaugaagggguagaaccagacgacguagauugcugguguaacacaacaucuacaugggugguuuacgguacaugucaucauaagaaaggugaagcaagacgcucaagacgagcaguaacacugccaucacauaguacaagaaaacuacaaacaagaucacaaacauggcucgaaucgagagaauacacaaaacaucuuauaagaguagaaaauuggauauucagaaaucccggcuucgcacuagcugcagcagcaauagcaugguuacuuggaaguucuacgagucaaaaaguaauauaucuaguaaugauacuucuaaucgcgccugcauauagcauaagguguaucggggucucaaauagagacuuuguagaaggaaugucaggaggaacauggguagauauuguguuagaacaugguggaugugucacaguaauggcacaagacaaacccacaguagacauagaauuaguuacuaccacaguaucaaacauggcagaaguucgaucguauuguuaugaagcauccauaagugauauggcaucagacaguagaugcccuacccaaggagaagcauauuuagauaaacaaagcgauacucaauacguauguaaaagaacccuaguagaucguggaugggguaacggaugugguuuauuugguaaaggcaguuuaguaacuugugcaaaguuugcauguucaaagaaaaugacagguaaaucuauacaaccggaaaaccuagaauaucgaauaaugcuaaguguacauggaucucagcauaguggaaugauaguaaaugacacagggcaugaaacagaugaaaacagagcgaaaguagaaauaacuccaaacagcccaagagcagaagcaacauuaggaggauuuggcagucuaggacuagauugugaaccaagaacuggauuagauuuuucagaucuuuacuacuuaacuaugaacaacaaacauugguuaguacacaaagaaugguuucaugacauaccgcuaccauggcacgcuggugcagauaccggcacaccucauuggaauaauaaagaagccuuaguagaauuuaaagacgcacaugcaaaaagacaaacaguaguaguacuaggaucacaggaaggagcaguacauacagcccuagcuggagcauuagaagcggaaauggacggagcuaaaggaagauugucaagcggacacuuaaaaugucgacuaaaaauggauaaacuaagacuuaaaggaguaucauauagcuuaugcacagcagcauuuacauuuacaaaaauaccggcagaaaccuugcaugggacuguaacaguagaaguacaauaugcagggacagauggcccauguaaaguaccagcacaaauggcaguagauaugcaaacccuaacuccaguaggaagauuaauaaccgcaaauccaguaauaacugaaagcacggaaaacucaaaaaugaugcuagaacuagauccaccauucggagacaguuauauaguaauaggcguaggagaaaagaaaauaacgcaccauuggcauagaagcggaaguacaaucggaaaagcauuugaagcaacaguaagaggcgcaaaaagaauggcaguacuaggagauacagcaugggacuuuggaucgguaggaggggcauuaaacaguuuagggaaaggaauacaucaaauauuuggagcagcauuuaaaucacuauucggaggaaugagcugguucucacaaauauuaauagggacauuauugauguggcuaggccuuaacacuaaaaauggaucaauaagucuaauguguuuggcauuaggcggaguacuaauauuuuuaucaacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4770 - RNA, 2287 nt, Artificial Sequence
  ZIKV prME variant mRNA Design 1 opt
gggagaaagcuuaccauggauaccucaguuggaauaguaggacugcuauuaacaacagcuauggcugccgaaguaacaagaagaggaagcgcauacuauauguacuuagauagaaaugaugcgggagaagcaauaaguuuuccaaccacacuaggaaugaauaaauguuacauacaaauaauggaucuagggcauaugugugaugcgacaaugucauaugaauguccaauguuggaugaaggcguagaacccgaugauguagacuguugguguaacacaacaagcacauggguaguauauggaacaugucaucacaagaaaggagaagcacgaagaaguaggagagcaguuacauuaccaucacauaguacuagaaaauugcaaacuagaucacaaacaugguuagaaagccgcgaauauacaaaacauuugauaagaguagaaaauuggauuuuuagaaacccaggcuucgcacuagccgcagcagcaaucgcauggcuucuaggaagcucuaccucacaaaaaguaauauauuugguaaugauauuauuaauagcaccagcuuauaguauaagauguaucggaguaaguaauagagauuuuguagaaggaaugaguggaggaacauggguagacauagucuuagaacauggaggauguguuacaguaauggcgcaagauaaaccaacaguagauauagaauuaguaaccacaacaguaaguaauauggcagaaguaagaaguuauuguuaugaagcaagcauuagugauauggcaucagauagucgauguccaacacagggagaagcauacuuggacaaacaaagugacacucaguauguauguaagagaacauugguagauagaggaugggguaaugguuguggauuauucggaaaaggaucguuggucaccugugcaaaauuugcuuguagcaagaaaaugaccggaaaaucaauucagccagaaaacuuagaauauagaauaauguuaagcguucauggaagucaacauagcggcaugauaguaaaugauacaggacacgaaacagacgaaaacagagcaaaaguagaaauuacaccaaauaguccaagagcagaagcaacauuaggagguuuuggaucucuuggauuggauugugaaccaaggaccggacuggauuuuucagaccuauauuacuuaacaaugaauaauaaacauugguuaguacacaaagaaugguuucacgacauuccauuaccuuggcacgccggagcagauacugggacaccgcauuggaauaauaaagaagcauuaguagaauuuaaagacgcacacgcaaaacgacaaacaguaguuguucuaggaagucaagagggggcaguucauacagccuuagcaggggcacuagaggcagaaauggauggagcuaaaggaagacuaaguaguggacacuuaaaauguagauuaaaaauggacaaauuacgucucaagggagucuccuauagcuuguguacagcagcauuuacuuucacaaaaauaccagcagaaacuuuacauggaacaguaaccguagaaguacaauaugcaggaacagauggaccaugcaaaguaccagcacaaauggcagucgacaugcaaacacuaacaccaguagggagacuaaucacagcaaauccuguaauaacagaaucaacugaaaauagcaagaugauguuagaauuagauccaccauuuggagauucauacauaguaauuggaguaggugaaaagaagauaacacaucacuggcacagaaguggaucaaccauaggaaaggcuuuugaagcaaccguaagaggugcaaaacgaauggcuguuuuaggagacacagcaugggacuuugggucaguagguggagcauuaaauagucuaggaaaagguauucaucaaauauuuggagcagcuuuuaaaaguuuauucggaggaaugucaugguucagccaaauauugauaggaacuuuauuaauguggcuaggauugaauaccaaaaaugguaguauuagucuaaugugucuugcguuaggaggaguauuaauauuuuuaagcacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4771 - RNA, 2284 nt, Artificial Sequence
  ZIKV (strain ZikaSPH2015) Polyprotein(108-794) mRNA Design 1 opt
gggagaaagcuuaccaugacaagcguaggaauaguuggauuauuacuaacaacagcaauggcagcugaaguaacuagaagaggaagcgcauauuauauguaccuagaucgaaacgacgcuggagaagcaauaucuuucccaacuacauuaggcaugaauaaaugcuauauacaaauaauggauuuaggacauaugugcgaugcaacaaugucauacgaaugucccauguuagacgaaggaguagaaccagaugauguagauuguuggugcaauacaacaucaacaugggucgucuauggcacaugucaucauaagaaaggugaagcacggagaagucgcagagcaguuacacuaccgucacauucaacaagaaaacuacaaacuagaucacaaaccugguuggaaaguagagaauauacaaaacaucuaauaaggguagaaaauuggauauucagaaaccccggauuugcuuuagcugcagcagcaauagcauggcuacuaggaaguagcacaucacaaaaaguaauauaucuaguaaugauacuacuaauagcgccagcguauaguauaagauguauaggaguaucuaaccgugauuuuguggaagggaugucagguggaacauggguagauauuguauuagaacauggaggauguguaacagucauggcgcaagacaaaccaacuguagauauagagcuaguaaccacaacuguaucaaauauggcagaaguuagauccuauugcuacgaagcaucgauuagcgauauggcaagugauuccagauguccaacccaaggagaggcuuacuuagauaaacaaagugauacacaauauguaugcaaaagaacauuagucgauagaggauggggaaauggaugcggguuauucggaaaaggaucuuuagugacaugugcaaaauuugcuuguucuaagaaaaugacaggcaaaucaauacaaccagaaaacuuagaauauagaauuauguuaucaguacacggaucacaacauagcggaaugauugucaaugauacaggacaugaaacagaugaaaauagagcaaaaguagaaauaacaccuaauucaccuagagcagaagcaacacuaggaggauucggaaguuuagguuuggauugcgaaccacgaacuggucuagauuuuucagauuuauacuauuugacaaugaauaauaaacauugguugguacauaaagaaugguuucaugacauaccacuaccuuggcaugcaggagcagacacuggaacaccacacuggaacaauaaagaagcacuugucgaguucaaagaugcacaugcuaaaagacaaacaguuguuguauuaggaagccaagaaggagcaguacauacagcauuagcaggggcguuagaagcagaaauggauggagcaaaaggcagacuuucuuccggacauuuaaaauguagauuaaaaauggauaaauuacgccuaaaaggugucucauacucauuauguacagcagcauuuaccuuuaccaaaauuccagcggaaacccuucauggaaccguaacaguugaaguucaauaugcuggcacagacggaccaugcaaaguaccugcacaaauggcaguagauaugcaaacucuaacuccaguugggagacuaauaacagccaauccaguuaucacagaaagcacagaaaauucaaagaugaugcucgaauuagauccgccauucggugacucuuauauaguuauaggaguaggugaaaagaaaauaacacaucauuggcaccguagcggaagcacuauuggaaaagcauuugaagcaacaguuagaggugcaaaaagaauggcaguacuaggagauaccgcaugggauuucggaagugucggcggagcacuaaauucauuagguaaagguauacaucaaauauuuggagcagcuuuuaaaagccuauuugguggaaugaguugguucucgcaaauauuaauaggaacccuuuuaauguggcuaggacuaaauacuaaaaauggaaguauaagccucaugugucuagcacuugggggaguauuaauauucuuauccacagcuguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4772 - RNA, 2284 nt, Artificial Sequence
  ZIKV prME variant mRNA Design 1 opt
gggagaaagcuuaccaugacgucaguaggaauugucggauuauuauuaacuacagcaauggcagcagcuguaaccagaaggggaucagccuacuauauguauuuggaccgaaaugaugcuggugaagcaauaucauuuccaacuacauuagguaugaauaaaugcuauauacaaauaauggaucuuggacauaugugugaugcaaccaugaguuaugaauguccuauguuagaugaaggaguagaaccugaugacguagauugcugguguaacacaacuucaacauggguaguauauggaacaugccaucacaagaaaggagaagcaagacgaagccggagagcaguaacauuaccaagucacucaacgagaaaauuacaaacaagaucacaaacauggcuugaaaguagagaauacacuaaacauuuaauaagagucgaaaacuggauauuuagaaauccaggauuugcacuagcagcugcagccauugcaugguuauuaggaucaaguacaucucaaaaagucauuuacuuaguaaugauauuacucauagcuccugcauauucaaucagaugcauaggcguuucaaacagagauuucguagaaggaaugucagguggaacauggguagauaucguacuagaacacggaggaugcguuacaguaauggcacaggauaaaccaaccguagacauagaauuaguaacaacuacuguaaguaauauggccgaaguaagaucauauuguuaugaagccaguauuagcgauauggccagcgauagcagauguccaacgcaaggagaagcauacuuagauaaacaaagugauacucaauauguauguaaacgaacauuaguagaucgaggaugggguaacggaugcgguuuauuuggaaaaggaucauuaguaacaugcgcaaaauuugcaugcucuaagaaaaugacuggaaaaucaauacaaccagaaaaucuagaauacagaauaauguuaucgguacauggaagccaacauucaggaaugauaguaaacgacacuggacaugaaaccgacgaaaauagagccaaaguagaaauaacaccuaauuccccaagagcagaagcaacauuaggaggauucggaagccuaggacuagauugugaaccaagaacuggucuugacuucucagacuuauacuaccuaaccaugaacaacaaacacugguuaguacauaaagaaugguuccacgacauaccauuaccuuggcacgcuggagcagacacaggcacaccccacuggaauaauaaagaggcuuuaguugaguucaaagaugcucacgcuaaaagacaaacaguaguaguacuagguucacaagaaggugcaguacauacagcuuuagcaggagcacucgaagcagaaauggauggagcaaaaggaagauuaucaaguggacaucuaaagugcaggcuaaaaauggauaaguuaaggcuaaaaggaguaucauauucucuaugcacagcagcauuuacauucacaaaaauaccagcagaaaccuuacauggcaccguaacaguagaaguacaauaugcagguacagauggcccuuguaaagucccagcacaaauggccguagauaugcaaacauuaacaccagugggcagauuaauaacagcaaaccccguaauaacugaaaguacagaaaauaguaaaaugaugcuagaauuagauccuccauuuggcgauaguuauauaguaauaggaguaggagaaaagaaaauaacacaucacuggcaccgcagcggaaguacuauuggaaaagcauuugaagcaacuguaagaggagcaaaaagaauggcuguucuaggagacacagcuugggacuuugguucuguaggaggagcacuaaauaguuugggaaaaggcauacaucaaauuuuuggcgcugcauucaaaucacuauuuggaggaaugaguugguuuucacaaauucucauaggaacauuauuaauguggcuaggguuaaacacgaaaaauggaaguauaucauuaauguguuuagccuuagguggaguauuaaucuucuuaucuacagcaguaucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4773 - RNA, 2296 nt, Artificial Sequence
  ZIKV prME variant mRNA Design 1 opt
gggagaaagcuuaccaugcguggagcugauaccucaguugguauaguaggcuuacuauuaacaacagcaauggcugccgcuguuacuagaagaggaucagcauauuauauguacuuagauagaaaugaugcaggagaagcaaucucauuucccacuacuuuaggcaugaauaaauguuacauucaaauaauggauuuaggacauaugugugaugcaacaaugucauacgaaugcccaauguuagaugaaggcguagagcccgaugauguagauuguugguguaauacuacaucuacuuggguaguguauggaacaugucaucacaaaaaaggagaagcaagacgaagcagacgagcaguaacauugccaucucacucaacaagaaaauuacaaacaagaucacaaacauggcuagaaucuagagaauacacaaaacauuuaauaagaguagaaaauuggauauuuagaaauccaggauucgcguuggcggccgcagcgauagcaugguuauuaggaucaaguacaucacaaaaaguuaucuauuuaguaaugauccuacuaauagcaccagcguauaguauuagauguauaggcguaucaaauagagauuucguagaggggaugagugguggaacauggguagauauaguuuuagaacaugguggguguguaacgguaauggcucaagauaaaccaaccguagauauagaguuagucacaacuacagucagcaauauggccgaaguaagaucauacuguuaugaagcaucaaucucagauauggccagugacaguagauguccaacucaaggagaagcuuaucucgacaaacaaagugauacacaauauguauguaaaaggacacuaguggauagagguugggguaaugguuguggacucuuuggcaaagguagucuagucacgugcgcuaaauuugcuugcucaaaaaaaaugacgggaaaaagcauacaaccugaaaauuuagaauaccgaauaauguuaucaguucauggcagucaacauagcgggaugauaguuaacgauacaggacaugaaacagaugaaaauagagcaaaaguggaaauaacaccuaacucaccuagagcggaagccacguuaggaggauuuggaaguuuaggauuagauugcgaaccaaggacaggauuagauuucucagauuuauauuaucuaacuaugaauaacaaacacugguuaguacauaaagagugguuccacgauauuccacuaccauggcaugcuggggcagacacuggaacaccucauuggaauaauaaagaagcauuaguagaauucaaagacgcacaugcuaaaagacaaacuguagugguacuaggaagucaagaaggagcaguacauaccgcacuugcuggagcacuagaagcagaaauggauggugcaaaaggaagacuuucaaguggacaucuaaaauguagauuaaaaauggacaaauuaagauuaaaaggaguaucauacucauuauguacagcagccuuuacauucacaaaaauaccugcagaaacacuucauggaacaguaacaguagaaguacaauaugcuggaacugauggcccguguaaaguucccgcucaaauggcaguugauaugcaaacauuaaccccugucgggagauugauaacagcuaauccaguuauaacagaaucuacugaaaacucaaaaaugauguuagaauuagacccaccauucggagauagcuauauaguaaucgggguaggugaaaaaaaaauuacacaccauuggcacagaaguggaucuacaauaggaaaagcauuugaagccacuguuagaggagcaaaacgaauggcaguacuaggugacaccgcaugggauuuuggaucagucggcggugcauuaaacucacuaggaaaaggaauccaucaaauauuuggagcugcauuuaaaagccuauuugguggaaugucaugguuuagccaaauacuaauuggaacuuuauuaauguggcuaggauuaaauacaaaaaauggaucaauuagcuuaauguguuuagccuuaggaggaguuuuaauauucuuaagcacagcuguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4774 - RNA, 2320 nt, Artificial Sequence
  ZIKV prME variant mRNA Design 1 opt
gggagaaagcuuaccaugagaggacuaucuagcagaaaaagaagaucacaugacguauuaaccguucaguucuuaauauuaggaauguuauuaaugacaggaggaguaacaagacguggcuccgcguauuauauguaccuagauagaaaugaugcaggagaagcaauuucauuuccuacaacuuuaggaaugaauaaaugcuauauacaaaucauggaccuaggacauaugugcgaugccacaaugagcuaugaauguccaauguuagaugaaggcguagaaccagaugacgucgauugcugguguaacacaacuucaaccuggguaguauauggaaccugucaucauaagaaaggagaagcaagacgaucaaggcgagcaguaacauuaccaucucacucaacaagaaaauuacagacaagaucacaaacauggcuagaaaguagagaauauacaaaacauuuaauaagagucgaaaauuggaucuuucguaauccugguuuugcacuagcugcagcugcuauagcuugguuauuaggcucaagcacaucacaaaaaguuauuuacuuaguaaugauauuacuaauagcaccagcuuacucaauaagauguauagguguuuccaacagagauuuuguagaagguaugucuggaggaacuuggguugauaucgucuuggagcaugguggauguguaacgguaauggcucaagauaaaccuacaguagauauagagcuaguuacgacaacaguuagcaauauggcugaaguccgaaguuauugcuacgaagcaagcauaagugauauggcaagugauucaagaugcccaacacaaggagaagcauaucuagauaaacaaagugacacacaauacguuuguaaaagaacucuuguagauagggguuggggcaauggaugugguuuauucggaaaaggaaguuuaguaacaugugcuaaauuugcuuguucuaagaaaaugacuggcaaaucaauucaaccagaaaauuuagaauacagaauaaugcuaucaguucaugguucacaacauucuggaaugauaguaaaugauacaggacaugaaacagaugaaaaucgugcuaaaguagaaauuacaccaaacucaccaagagcagaagcaacucuugguggauuuggcucauugggguuggauugcgaaccaagaacuggauuagauuucagugauuuguauuauuuaacuaugaauaauaaacacuggcuaguucauaaagagugguuccacgacauaccauuaccauggcacgcaggagcagauacaggaacaccacauuggaacaauaaagaagcacucguugaauuuaaagaugcacaugcaaaaagacaaaccgugguaguauugggaucucaagaaggagcaguucacacagcacuagcaggagcauuagaagccgaaauggacggagcaaaaggaagguuaucuucagggcaucuaaaauguagauuaaaaauggacaaacuaagauuaaaagggguaaguuauucacuauguacagcagcuuuuacauucacaaaaauaccugcagaaacacugcacgggacaguaacaguagaaguacaauaugcaggaacagaugguccauguaagguacccgcacaaauggcaguugacaugcaaacucuaacgccaguaggaagacuaaucacagcuaauccaguaauaacagaaucaacugaaaacucaaaaaugaugcuagagcucgauccaccuuucggagauucauacauugugauagguguuggagaaaagaaaauuacacaucauuggcauagaucaggaucaacuauaggaaaagcauuugaagccaccguaagaggagcaaaaagaauggcugugcuaggagauacugccugggauuuuggaaguguaggaggagcauuaaauucacuagggaaaggaauacaucaaauauuuggagcagcauuuaaaucacuauuuggugguaugagcugguuuucacaaauucuaauaggaacauuauuaaugugguuaggucuaaacacuaaaaacggaagcauaucuuuaaugugccuagcacuaggugggguacucauauuucuaagcacugcugugagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4775 - RNA, 2320 nt, Artificial Sequence
  ZIKV prME variant mRNA Design 1 opt
gggagaaagcuuaccaugagaggguuaucaagucgaaaaaggagaucacaugauguuuuaacaguacaauuuuuaauuuugggcaugcuacuuaugacuggagcaguaacaaggagaggaagugccuauuauauguaucuugauagaaaugaugcaggagaagcaauuucauuuccaacaacauuaggaaugaauaaauguuauauacaaauaauggauuuaggacacaugugugaugcaacaaugucauacgaauguccaaugcuagaugaagguguggaaccugaugauguagauugcugguguaacacaacaagcacuuggguaguauacggaacaugucaccacaagaaaggggaagcaagaagaaguagaagggcaguuacccuaccaagccauucaacaagaaaauuacaaacaagaucacaaacauggcuagaaaguagagaauacacaaaacacuuaauaagaguagaaaacuggaucuuuagaaauccaggauucgcacuagcagcugcugcuauugcuuggcuauuaggaagcaguacuagccaaaagguaauauaucuuguuaugauauuacuaauagcaccagcauacucaauaaggugcauaggaguaucaaauagagauuuuguagaaggaauguccggagguacauggguggauauuguacuagaacauggcggcugcgucacagugauggcacaagacaaaccaacaguagauauagaauuaguuacaacaacagucucgaauauggcagaaguaagaaguuauuguuacgaagcaagcauaagugauauggcaagcgacagucggugcccuacucagggagaagcauauuuagauaaacaaucagauacccaauacguauguaaacgaacucuaguagacagaggguggggaaauggauguggacuauuugguaaaggaucacugguaacaugcgcaaaauuugcaugcaguaagaaaaugacaggcaaaaguauucaaccugaaaauuuggaauauagaauaaugcuuagcguacauggaucacaacacucaggaaugauagugaaugauacaggacacgaaacagaugaaaauagagcaaaaguagaaauaacaccuaauaguccuagagcggaagcaacacuaggaggauucggaucauugggucuugacugugaaccacgaacuggguuagauuuuucagaucuauauuauuuaacaaugaauaauaaacauugguuaguacacaaagagugguuccaugauauaccauugccauggcaugcaggagcggauacuggaacaccgcauuggaacaacaaagaagcacuuguagaauuuaaagaugcacaugcaaaaaggcaaacaguaguaguacuuggaucucaagaaggagcaguacauacugcuuuagcaggagcauuagaagcugaaauggauggagcaaaagguagacuaagcucgggacacuuaaaaugcagacuaaagauggauaaauuaagauuaaaaggugugucguacaguuuauguacagcugcauuuaccuuuacuaaaauaccagcagaaacauuacauggcacuguaacaguugaaguacaauaugcaggaaccgaugguccaugcaaaguaccagcucaaauggcaguagauaugcaaacgcuuacuccaguaggaagguuaauaacagcuaauccaguaauaacugaauccaccgaaaauagcaaaaugauguuagaauuagauccaccauuuggggauucauauauaguuauaggaguaggagaaaagaaaauaacucaccauuggcacagaucaggaaguacaauaggaaaagcguucgaagcaacaguaaggggagcaaaacgaauggcaguauuaggagacacagcaugggacuuugguucaguaggcggagcauugaauagcuuaggaaaaggaauacaccagauauuuggcgcagcuuucaagagcuuauuuggaggaaugucgugguuuagccaaauacuaauaggaacuuuauugauguggcuaggacugaacacuaaaaacggaaguauuucauuaauguguuuagcauuaggaggaguauuaaucuuuuuaucaacagcaguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4776 - RNA, 2359 nt, Artificial Sequence
  KU321639.1 prME-long mRNA Design 1 opt
gggagaaagcuuaccaugcguauaauaaaugcaagaaaagaaaagaaaagaagaggcgcagauacaagcguaggcauaguuggguuacuguuaacaacagcuauggcugcagaaguaacaagaagagguagcgcuuauuacauguauuuagacaggaaugacgcuggagaagcaauuagcuuuccaacaacuuuaggaaugaauaaauguuauauucaaauaauggaucuaggacacaugugcgacgcaaccaugaguuaugaauguccaaugcuagacgaaggaguagaacccgaugauguugauuguugguguaauacaacgucaaccuggguuguauauggcacaugucaucauaagaaaggagaagcaagaagaaguaggagagcaguaacacuaccuucacauucaacuagaaaacuacaaacucguagccaaacauggcuagaaucacgagaauauacaaaacaucugauaagaguagaaaauuggauuuuuagaaauccuggauuugcucuagcugcagccgcaauagcauggcuacuaggaucuaguacuagccaaaaagugauauacuuaguaaugauauuacuaauagcuccugccuacaguauacgcugcauaggaguaagcaauagggacuucguagagggaaugucaggaggcacauggguagauauaguacuagaacacggaggauguguaacaguaauggcccaggauaaaccaacuguagauauugagcuaguaacuacaacuguaucaaacauggcugaagucagaaguuacuguuacgaagcaaguauaagugauauggccucagauucacgauguccaacucaaggagaagccuaucuagauaaacaaucagauacucaauauguauguaaaagaacuuuaguagauagaggcuggggaaauggcuguggauuauuuggaaaaggcagcuuagucacaugcgcaaaauuugccugcagcaagaaaaugacgggaaaaucgauacaaccggaaaauuuagaauauagaauaauguuaucaguacacgggagccaacauucaggaaugauaguaaaugauacaggacacgaaacggaugaaaauagagccaaaguugaaauaacaccuaacaguccaagagcagaagcuacacuagguggauucggcucauuaggauuggauugugaaccacgaacuggcuuagacuucucugacuuauacuacuuaacuaugaauaauaaacauuggcuaguacauaaagaaugguuccaugacaucccuuuaccauggcaugcaggagcagauacaggaacaccucauuggaauaauaaagaagcacuuguagaguucaaagaugcacaugcuaaaagacaaacaguaguaguauuaggaucacaagaaggugccguacacacugcgcuagcuggugcauuagaagcggaaauggauggagccaaaggaagacuaucuuccggacaucuuaaauguagauuaaaaauggauaaacuaagauuaaaaggaguaagcuauaguuuaugcacagcagcuuuuacauuuacaaaaauaccggcagaaacauuacauggaacaguaacaguugaaguucaauaugcgggaacggauggaccuugcaaagucccagcccaaauggcuguggacaugcaaacauuaacgccaguaggaagacucauuaccgcaaauccaguaauaacugaaucaacggaaaacaguaaaaugaugcuagaacuagacccuccauuuggagacagcuauauaguaauaggaguaggagaaaagaaaauaacacaucauuggcaucgaucuggaaguaccaucggaaaagcauuugaagcgacaguacgaggagccaaaagaauggccguauuaggcgauacagcuugggauuucgguucggucggaggcgcauuaaauaguuuaggaaaaggaauacaucaaauuuucggagcagcauucaaaagccuauuugggggcaugagcugguuuucacaaauacucaucgguacuuuauuaauguggcuaggacucaauacgaaaaaugguaguaucucauuaauguguuuagcauuaggcggaguauugauuuuucuuaguacagcaguaagugccgacguaggaugcucaguagauuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4777 - RNA, 2359 nt, Artificial Sequence
  KU312312.1 prME-long mRNA Design 1 opt
gggagaaagcuuaccaugagaauuauaaacgcuagaaaagagaaaaagcguagaggagcugauacaagcguugggauaguagguuuguuacuaacaacagcaauggcagcagaaguuacaagaagagggagugcauauuacauguaucuagacaggaacgaugcuggugaagcaauuucauucccaacaacauuaggaaugaauaaauguuauauacaaauaauggacuuaggacacacaugcgaugcaacaaugucauaugaguguccgauguuagaugagggaguagaaccagaugacguagauuguugguguaauacaacaaguacaugggucguguauggaacaugccaccauaagaaaggagaagcaagaagaaguagacgagcaguaacauuaccaagucacaguacaagaaaacuacaaacuagaagucaaacaugguuagaaucuagagaguauacaaaacacuuaaucagaguagaaaauuggauauuuagaaauccaggauuugcauuagcagcugcggcaauagcuuggcuauuaggaagcucaacaucucaaaaaguaauauauuuaguaaugauacuauuaauagcaccagcuuauagcauaagguguauuggaguaucaaauagagauuucguugaaggaaugucaggaggaacauggguagauguuguucuagaacauggagguugcguuacagucauggcacaagauaaaccaacaguagauauagaauuagucacaacaacaguuaguaacauggcagaaguacgcucauauuguuaugaagcaagcauaagcgauauggcaucagauucaagauguccaacacaaggagaagcauauuuagauaaacaaucugacacacaauauguauguaaacguacguuaguagaccguggaugggggaacggauguggauuauuugguaaaggaucguuaguaacaugcgcaaaauucgcaugcaguaagaaaaugaccggaaaaagcauacaacccgagaacuuagaauauagaauaauguuaagcguacauggcagccaacauaguggaaugaucgucaacgauacaggacaugaaacagaugaaaauagagcuaaaguagaaauaaccccaaacagcccaagagcagaagcaacauuagguggauuugguucacuaggauuagauugcgaaccuagaacgggccuggauuuuagugaccuauacuauuuaacaaugaauaauaaacacugguuaguucauaaagaaugguuucaugauauuccucuaccauggcaugcaggcgcagauacagguacaccacacuggaacaauaaagaagcauuaguagaguucaaagaugcacacgcaaagagacaaacugucgugguacuagguagucaagaaggugcaguucauacagcacucgcaggagcguuagaagcagaaauggauggagcgaaaggaagauugaguucaggucaucuaaaaugccgacuaaaaauggauaaauuaagguuaaaagguguaucauauucauuaugcacagccgcuuucacauuuacaaaaaucccagcagaaacuuuacauggaacaguaacuguagaagugcaauaugccggaaccgauggaccaugcaaagucccugcucaaauggcuguagacaugcaaacauuaacgccaguuggaagacuaauaacagcaaaccccguaauaacggaaagcaccgaaaacagcaaaaugaugcuagaauuagauccaccuuuuggagacaguuauaucguuauaggcguaggcgaaaagaaaauuacccaucauuggcauagaaguggaagcacaauuggcaaagcauucgaggcaacaguaagaggcgccaaaagaauggcugucuuaggagacacagcaugggauuuuggaagugucggaggagcauuaaauagccuuggaaaaggaauacaucaaauauuuggggcagcauucaaaucacuauuuggaggaaugagcugguuuucacaaauuuuaauagguacccuauuaaugugguuaggacuaaaugcuaaaaauggaaguauaaguuuaaugugucuugcauuaggaggaguauuaauauuucuaucaacggcuguaucagcugauguaggauguaguguagacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4778 - RNA, 2347 nt, Artificial Sequence
  AY632535.2 prME-long mRNA Design 1 opt
gggagaaagcuuaccaugagaauaaucaacgcucgaaaagaacgaaaaagaagaggagcagauacuaguauuggcauaauaggucuauuacuuacuaccgcuauggcagcugaaauaacaagaagaggaagcgcauacuacauguauuuagauagaagugaugcaggaaaagcaauuucuuuugcaacgacauugggaguaaauaaaugccacguucaaauaauggaucuaggacauaugugugaugcuacuaugucauacgaauguccgauguuagaugaaggaguagaaccagacgacgucgauuguugguguaauacaaccagcacauggguaguguacggaacaugccaccauaaaaaaggagaggcaagacgaagcaggcgagcaguaacauugccgagucacucaacaagaaaacuacaaacuaggucacaaacaugguuagaaaguagagaauauacaaaacauuuaauaaaaguggaaaauuggauauuuagaaauccaggauucgcucuaguugcuguggcaauagcuugguuauuagguaguaguacuagucaaaaagucauauaucuaguuaugauucuacugauagcaccagccuauucuauaagauguauaggaguaucuaacagagacuuuguagaagguaugucgggaggaacuuggguagauguaguacuagaacauggagguuguguaacggucauggcacaagauaaaccuacuguagacauagaauuaguaacaaccaccguaucgaacauggcagaaguaagaucuuauugcuaugaagcaaguauuagcgauauggcaagcgacucaagaugcccuacucaaggagaagcauacuuagacaaacaguccgauacucaauauguguguaaaagaacuuuaguagauagaggauggggaaacggcuguggacuauuuggcaaaggaucauuagugacaugugcaaaauuuacauguagcaaaaagaugacagguaaaaguauacaaccagaaaauuuagaauacagaauaauguuaaguguacauggcucucaacauagcggaaugauaggauaugaaacagaugaggauagagcaaaaguagaaguaacaccuaauaguccucgugcagaagcaacucuggguggauucggaagccuaggauuggauugugaaccacgaacaggauuagauuuuagugaucuauauuacuuaacaaugaauaauaaacauuggcuaguccauaaagaaugguuucaugacauuccauuaccauggcacgcaggugcagauaccggaacaccacacuggaauaauaaagaagcuuuaguagaauuuaaagacgcgcaugcaaagaggcaaacggugguaguauugggaucacaagagggagcaguacauacagcucuagcaggagcacuugaagcagagauggacggugcaaaaggaagauuauuuucaggacacuuaaaauguagacucaaaauggauaaauuaagguuaaaaggagucagcuauagcuuaugcacagcagcauuuacauucacaaaaguaccagcagagacauuacaugggacaguuacaguugaaguacaauaugcgggaacagauggaccauguaaaauacccgugcaaauggcaguugacaugcaaacauuaacaccuguaggaagauuaauuacagcgaacccaguaauaacagaaucuacagaaaauaguaaaaugauguuagaacuagacccaccauuuggagauaguuauauagugauaggagugggugauaaaaaaaucacacaucacuggcauaggaguggaucuacuauuggaaaagcuuuugaagcaacaguaagaggagcaaaaagaauggcaguuuuaggagauacagcaugggauuucggaagcguaggagggguauuuaauagccuagggaaagguauucaucaaauauuuggagccgcauuuaaaagucuauucgguggaaugaguugguucucacagauauuaauaggaacauuauuagucugguuaggauuaaauacaaaaaaugggucaauaucucugacaugucuagcacuagguggaguaaugauauuucuaaguacagcaguaagcgcagaugucggauguagcguagacuuuucgaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4779 - RNA, 2359 nt, Artificial Sequence
  KU527068.1 prME-long mRNA Design 1 opt
gggagaaagcuuaccaugagaauaauaaaugcgagaaaggaaaaaaaacgacgaggagcagauacaucaguuggaauaguaggcuuauuauuaacaacggcaauggccgcagaagugacaagaagaggaagugcauauuacauguauuuagauagaaacgaugcuggagaagcuauaucuuuuccaaccacauuaggaaugaauaaauguuacauacaaauaauggauuuaggucauaugugugaugcuacaaugucauaugaguguccaauguuagaugaagguguagaaccugaugacguagauuguuggugcaacacaacaaguacauggguaguauauggaacaugucaucauaaaaaaggagaagccagaagaagcagacgugcuguaacauuacccucacauagcacaagaaaacuacaaacccgaagucaaacgugguuagaaucuagagaauacacaaaacaucuuauaagaguagagaauuggauauuuagaaauccugguuucgcauuggcagcagcagcaauugcguggcuacuaggaucgucuacaagucaaaaaguaauauacuuaguaaugauauuacuuauagcgccugcauauaguauaagauguauaggaguaagcaauagagauuuuguagaagguaugucaggggguacguggguagauguaguauuagaacaugguggaugcgucacaguaauggcacaagacaaaccuacaguagauauugaacuaguaacaacaacaguaucaaauauggccgaaguaagaucauauuguuaugaagcaucuauaagugauauggcuagugacaguagauguccaacacaaggugaagcauaucuagauaaacaaagcgauacacaauauguguguaaaagaacauuaguagauagaggaugggguaacggaugugguuuauuuggaaaaggauccuuaguaacgugugcaaaauuugcuuguagcaaaaaaaugacaggaaaaucaauccaaccagaaaauuuagaauauagaaucauguuguccgugcaugguagucaacacucuggaaugauuguaaaugauacaggacaugaaaccgaugaaaauagagcaaaaguugaaauaacaccgaauagcccaagggcagaagccacauuaggaggauuuggcucguuaggucuagauugugaaccaagaaccggauuagauuuuagugaccuauauuaucuaacuaugaacaacaaacacugguuaguucacaaagaaugguuucacgauauacccuuacccuggcaugcuggggcagacacagguacaccacauuggaauaauaaagaagcacuuguagaauucaaagacgcucaugccaagagacaaacuguaguugugcucgguagucaggaaggugcuguacacacagcacuugcaggagcacuugaagcagaaauggauggagcaaaggguagauuaucuaguggucauuuaaaauguagauuaaaaauggacaaauuaagauuaaaaggcguaaguuauucacuauguacugcagcauuuacauuuaccaaaauaccagcagaaacacuacauggaacugucacaguagaaguacaguaugccggaacagaugguccauguaaagugccggcucaaauggcaguugauaugcaaacauuaacaccaguaggaagauuaauaacagcaaauccgguuauuacagagucuacggaaaauucgaaaaugaugcuugaacuagacccaccauucggugacaguuacauugucauugguguaggugaaaaaaaaauaacacaccauuggcauagaucaggaaguacaauaggaaaagcauuugaagcuacagugagaggagcgaaacgaauggcaguacucggugauacagcaugggauuuuggaucuguagguggagcauuaaauaguuuaggaaaagguauacaucaaauauuuggagcagcuuuuaaaucacuauuuggaggaaugucaugguuuucucaaauucucauagguacacuauuaauguggcuaggccuaaauacaaaaaacggaagcauaaguuuaauguguuuagcuuuaggagguguuuuaauuuuuuuaaguacagcgguaucagcagauguaggauguucaguugauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4780 - RNA, 2359 nt, Artificial Sequence
  KU720415.1 prME-long mRNA Design 1 opt
gggagaaagcuuaccaugagaauaauaaaugcaagaaaagagcgaaaacguagaggagcagauacaagcauuggaaucauagguuuacuauugacaacagcaauggcugcugaaauaacuagaagaggcuccgccuauuauauguaccuagacaggucagacgcagguaaagccauaagcuuugcaacaacauuaggcguaaauaaaugucauguacaaauaauggauuuaggacauaugugugacgcuacaaugaguuaugaauguccaauguuagaugaaggaguggaaccagacgauguugauuguugguguaauaccacuaguacauggguaguauaugguacgugucaccacaaaaaaggcgaagcaagaagauccagaagagcggucacauuaccaucacauucaacuagaaaacuacaaacaagaucccaaacauggcuugaaagcagagaguacacuaaacaccuaauaaaaguagaaaauuggauauucagaaacccuggauuugcauugguagcaguagcaauagcaugguuauuaggaaguagcaccucacaaaaaguaauauaucuaguaaugauucuacuaauugcaccagcauauucaauaagaugcauagguguuuccaauagagauuuuguagaaggaaugucaggaggaacauggguagacgucguccuagaacacggugggugcguaacuguaauggcacaggauaaaccaacuguagauauagaauuaguaacaacaacuguaucuaauauggcagaaguaagaucauauuguuacgaagcaucaauaucugauauggcaagugauuccagaugcccaacacaaggagaagcauauuuagauaaacaaucagauacacaauauguuuguaaaagaacccuggucgaucgagguugggguaauggauguggucuuuuugguaaaggaagccuaguaacaugugcaaaauuuacauguagcaaaaaaaugacaggaaaaucuauacaaccagaaaaucuugaauauagaauaauguuaaguguucauggaagccaacauucaggcaugauagugaaugauacagguuaugaaacagaugaaaacagggcgaaaguagaaguaacaccaaacucaccacgagcagaagccacuuuaggaggauucggaucauuaggacuagacugugagccaagaacaggauuggauuuuagugaucuauacuauuuaacaaugaauaauaaacacugguuaguacacaaagaaugguuccaugacauaccauuaccuuggcacgccggagcagacacaggaacaccccacuggaauaauaaagaagcgcuaguagaauuuaaagaugcacacgccaaaagacaaacugucguaguauuaggaucacaagaaggugcaguacauacagcucucgcaggagcauuagaagcagaaauggacggagccaaagguaaacuuuuuucaggacauuuaaaauguagauuaaaaauggauaaauugcgacuaaaagguguaagcuauucacuauguacagcagcauuuacauucacaaaaguacccgcagaaacacuacauggaaccgugacaguagaaguucaauaugcaggaacagauggcccauguaaaauaccuguacaaauggcaguagauaugcaaacacuaacucccgucggcagauuaauuacagcaaauccaguaauaacugaaaguacagaaaauucaaaaaugaugcuagaauuagauccgccauucggagauucauacauaguuauuggcgugggagacaaaaaaauuacacaucacuggcauagaagcggaaguaccauaggaaaagcuuuugaagcaacaguucgaggagcaaaaagaauggcaguauuaggugacacugccugggauuucgguuccguaggaggaguuuucaauucauuaggcaaagguauucaccaaauauuuggugcggcauucaaaucauuauuuggagguaugucaugguuuagucaaauacuaauaggaacauuacuaguaugguuaggauuaaauacaaaaaacggguccauaucuuuaacauguuuagcucuagguggcguuaugauauuuuuaaguacugcaguaagugcagauguuggcugcucagucgauuuuucuaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4781 - RNA, 2341 nt, Artificial Sequence
  DQ859059.1 prME-long mRNA Design 1 opt
gggagaaagcuuaccaugagaauaauaaaugcaagaaaagaaagaaaaagaagaggggcugauacaaguauagguauaguaggacugcuauuaacaacggcaauggcugcagaaauaacaaggaggggaucagcauauuacauguaucuagauagaucugaugcgggaaaagcaauaucuuuugcgacaacuuuaggaguaaauaaaugccauguacagauaauggauuuaggacauaugugcgaugcgacuaugaguuaugaaugcccaauguuagacgaagggguugaaccagacgacgucgauuguugguguaauacaacgaguacuuggguaguauauggaacaugccaucacaagaaaggcgaagcaagaagaagcagacgagcgguaacauuaccaucacauucaacaagaaaacuacaaacaaggucacaaacauggcuagaaagcagagaauauacaaaacauuuaaucaaaguagaaaauuggaucuucagaaauccagguuuuacucuaguagccgucgcaauugcaugguuauuaggaaguaguacaucacaaaaaguaauauauuuaguaaugauacuauuaauagcgccagcauauaguaucagauguauaggaguaagcaauagagauuuuguagaaggaaugucaggagguacauggguagacgugguacuugaacauggagguuguguuacuguaauggcacaagauaagccgacuguagauauagaauuaguuacaacaacuguaaguaauauggcagaaguucgaaguuauuguuacgaagcaucgauaagugauauggcaucagacucaagauguccuacacaaggugaagcauaucuagacaaacaaucagauacacaauacguauguaaaagaacauuaguagaucguggguggggaaauggaugcggauuguuuggaaaaggaagccuaguaacaugcgcuaaauuuaccuguaguaaaaagaugacuggaaaaucaauucagccggaaaaccuagaauacagaauaaugcuaucaguacacggaagucagcauucagguaugaucguaaaugacgaaaauagagcuaaaguagaagugacgccuaacaguccaagagcagaagcuacgcuaggagguuuugggagucucggauuagauugugaaccuagaacaggauuggauuuuagcgauuuauacuacuuaacuaugaauaauaaacauuggcuuguacauaaggaaugguuucaugacauaccauuaccauggcaugcaggagcagauacagguacaccccauuggaauaauaaagaagcucuaguugaguucaaggaugcacaugcuaaaagacaaacagucguaguauuggggucacaagaaggugcaguacauacagcucuugcuggagcacuagaagcugaaauggauggagcuaaaggaagacuguuuaguggucauuuaaaaugucgauuaaaaauggacaaauuaagauugaaagggguaagcuacucuuuauguacugcagcauucacguucacuaaaguaccggcugaaacauuacauggaacaguaacaguagaaguacaauaugcggguacagauggaccauguaaaguaccagcucaaauggcgguagauaugcaaacacuaacaccaguugggagauugauaacagcgaacccaguaauaacggaaaguacagaaaauaguaaaaugauguuggaacuugacccaccauucggagauaguuauauaguuaucggaguaggagauaagaaaauuacacaucauuggcauagaaguggaaguacaauugggaaagcauuugaagccacuguuagaggggcaaaaaggauggcaguuuuaggagauacagcaugggacuuuggaagcguaggcgguguuuuuaauagucuagguaaagggauacaucaaauauuuggugcagcauucaaaaguuuauuuggagggaugucaugguucagucaaauucuaauugguacacuauuaguaugguuaggucuaaauacgaaaaauggaaguauuucauugacaugucuugcauuagguggaguaaugauuuuccuaaguacagcuguuagugcagaugugggauguaguguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4782 - RNA, 2359 nt, Artificial Sequence
  KX377335.1 prME-long mRNA Design 1 opt
gggagaaagcuuaccaugagaauaauaaacgcuagaaaagaaagaaaaagaagaggagcagauacauccauaggaauaauaggauuacuucucacaacagcgauggcagcagaaaucacaagacgcggaagugcauacuauauguaucuagauagauccgaugcaggaaaggcgauaucauuugcaacgacauuaggcguuaauaaaugucauguacaaauuauggauuugggccacaugugugaugcuaccaugaguuacgaauguccuaugcuagaugaaggaguagaaccugaugauguggauuguuggugcaacacaacaucaacaugggugguuuaugguacuugccacagaaagaaaggugaagcaagaagaagcagacgagcaguaacacuuccaucccauucaacacggaaacuacaaacaagaucacaaacaugguuagaaucuagagaauacacaaaacaucuuauaaaaguagaaaauuggauuuuuagaaacccaggauuugcauuaguagcuguugcuauagcauggcuucuagguucaucaacaucacaaaaaguaauuuauuuaguuaugauauuauuaauagcuccagcauauaguauuagauguauuggaguaucgaauagagauuuuguugaagguaugaguggaggcacauggguggacgucguauuagaacacgggggauguguaacaguaauggcacaagacaaaccaacaguugacauagagcuaguaacuacaacaguaaguaacauggcagaaguaagaagcuauuguuaugaagccaguaucagugacauggcaagugacaguagauguccuacacaaggagaggcuuauuuagauaaacaaagugauacacaguauguauguaaaagaacauuaguagauagagguuggggaaauggcuguggacucuuuggaaaaggaucgcuaguaacaugugcaaaauuuacauguucaaagaaaaugacuggaaaaucaauucaaccagaaaacuuggaauaccgaauaaugcuaagcgugcauggaucccaacauagcgggaugauaguaaacgauacaggauaugaaacugacgaaaacagagcaaaaguagaaguaacuccaaauaguccaagagcagaagcaaccuuaggaggauuugguucuuuaggacuagauugcgaacccagaacaggauuagacuuuagugaccuuuauuauuuaaccaugaauaacaaacauuggcuaguucauaaagaaugguuucaugauauaccauuaccauggcaugcaggcgcagauacuggcacuccacauuggaacaauaaagaagcgcuaguagaauuuaaagacgcucaugccaagagacaaacaguggucguacuuggaagccaagaaggcgcagugcauacagcucuagcaggagcacuagaagcagaaauggauggugcaaaaggaaaguuauuuaguggacauuuaaaauguagacuaaaaauggauaaauuaagauuaaaaggagucagcuacucgcucugcaccgcagcauuuacauuuacaaaaguaccagcagaaacauuacauggaacaguuacaguugaaguacaauaugcagguacagauggaccauguaaaauaccaguucaaauggcuguagacaugcaaacauuaacgccuguagggagacuaauaacagcaaauccagucauaacggaaucaacagaaaacaguaaaaugaugcuagaacucgacccuccauucggagacucauacauaguaauuggaguuggagacaagaaaauuacucaccauuggcacagaucagggucaacaauaggaaaagccuucgaagcaacuguaagaggagcuaaaagaauggcuguauuaggcgacacagcaugggauuuuggauccgucggaggaguauuuaauagcuuaggaaaaggaauacaccaaauauuuggagcggcuuuuaaaucacuuuuuggcggaaugucaugguuuucacaaauacuuauaggaacucuauuaguaugguuaggccuaaauacuaaaaauggaaguauaucauuaacaugucuagcauuaggaggagucaugauauucuuaagcacagcaguaagugccgacguaggaugcucaguagauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4783 - RNA, 2359 nt, Artificial Sequence
  LC002520.1 prME-long mRNA Design 1 opt
gggagaaagcuuaccaugagaauaauaaaugcaagaaaagaaagaaaaaggagaggugccgauacgucuauagguauaauaggauuauuacuaacuacagcaauggcggcagaaauaacacgaagaggaagugcguacuacauguaucuagacagaagugacgcaggaaaagcaauuagcuucgcaacaacacuugguguaaauaaaugucauguccaaauaauggauuuaggacauaugugugaugccacaaugucauaugaauguccaaugcuagaugaaggaguggagcccgaugacguugacuguugguguaauacaacaagcacuuggguaguauaugguacuugccaucauaagaaaggugaagccagaagaagcagacgagcaguuacauuaccaucacacagcacuagaaaauuacaaacaaggagucagacuugguuagaaagucgagaauacacaaaacaccuaauuaaaguagaaaauuggauauuuagaaacccuggcuucgcauuaguagcaguugcaauagcauggcuacuagguaguaguacaagucagaaaguaauuuauuuagucaugauccuauugauagcaccagcauauucaauaagauguauugggguuucaaauagagauuucguagaggggaugaguggcggaacauggguagacguaguauuagaacauggaggcuguguuacgguaauggcgcaagauaaaccaacugucgauauagagcuaguaacaacaacaguaucaaauauggcagagguaagaucuuacuguuaugaggcaaguauaagugauauggcaucagacaguagauguccuacacaaggagaagcauauuuagauaaacaaucggauacacaauauguauguaaaaggacgcuaguagaucgaggauggggaaacggauguggauuauucggaaaaggaaguuuaguuacaugcgcaaaauucacauguucaaagaagaugacaggaaaaucaauacaaccagaaaaccuagaauacagaauaauguuaucuguacacggaagucagcauucaggaaugacaguaaaugacauaggauacgagacugaugaaaauagagcuaaaguagaaguaacuccaaauucaccgagagcagaagcuacauuaggaggauuuggaagucuaggacuagacugugaaccucgaacagguuuagauuuuagugauuuauauuacuuaacaaugaacaacaaacacuggcuaguucauaaagaaugguuucaugacauaccauuacccuggcacgcuggugccgauacaggaaccccacauuggaacaauaaagaagcauuaguagaauuuaaagaugcacaugcaaaaagacaaacaguaguagucuuggguucacaagaaggcgccguacauacggcauuagcaggggcuuuagaagcagagauggauggcgcaaaagguaaauuauuuucgggacaccuaaaaugcagauuaaaaauggauaaauuacgauuaaaaggaguaucauauucacuauguacagcagcauuuacauuuacaaaaguaccagcugaaacucugcacggaacagugacgguagaaguucaauacgccgguacagauggaccaugcaaaauaccuguacaaauggcuguagauaugcaaaccuuaacaccaguaggaagauuaauuacugcaaauccaguaauuacagagagcaccgagaauagcaaaaugaugcuagaauuagauccaccuuuuggugauucauauauaguaaucgguguuggagauaagaaaauaacacaccacuggcauagaucaggaucaacaauagguaaagcauucgaagcaacaguaagaggcgcaaaacgaauggcuguacuaggugauacagcuugggauuuuggaucaguaggaggaguauuuaacagucuaggaaaaggaauacaucagauuuuuggggcagcauucaaaaguuuauuuggaggcaugagcugguucagucaaauauuaauuggaacacuuuuaguauggcuaggauuaaauacgaaaaaugguaguauaagucugacaugucuagcauuaggugguguaaugauauuucuuagcacagcggucagcgcagauguaggauguucuguggacuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4784 - RNA, 2347 nt, Artificial Sequence
  KU963573.2 prME-long mRNA Design 1 opt
gggagaaagcuuaccaugcgcauaauaaaugccagaaaagaaagaaaaaggagaggugcagauacauccauaggaauaauaggacuguugcuaacgaccgcaauggcagcagaaauuacaaggaggggcucagcauauuauauguaucuagauaggucugaugcaggaaaagcaauaaguuuugcaacaacacuagggguaaauaaaugccauguucaaauaauggauuuaggacauaugugugaugcaacaaugaguuacgaaugcccuaugcuagacgaaggaguggaaccggacgacgucgauugcugguguaauacaacuucaacauggguuguauaugguacuugccaucauaaaaaaggagaagcaagaagaagccgaagagcaguaacacuaccaagccauagcacucgaaaauugcaaacaagaucucagacauggcuagaaucaagagaauauacaaaacauuuaaucaaaguagaaaauuggauauuuagaaauccaggauucgcccuaguagcaguggcaauagcaugguuauuaggaucuucaacaagucaaaaagucauauauuuagugaugauuuugcuaauagcuccagcauauucuauaagauguauaggaguaucaaacagagacuuuguugaaggaaugaguggcggaacauggguagauguaguauuagaacauggaggaugugugacaguaauggcucaagauaaaccaacuguugauauugaacuuguaacaacaacaguaucuaacauggcugaaguaagaaguuauuguuaugaggcuucuauaucagauauggccucagauaguaggugcccuacacaaggagaagcauacuuagauaaacaaagugacacacaauacguauguaaacgaacuuuaguagauagagguuggggaaauggcuguggucuauuuggaaaaggaagucuaguaacaugugcaaaauuuacauguucaaaaaaaaugacuggaaaaucaauucaaccagaaaauuuagaguauagaauaaugcuaucaguacauggaagucaacacagugggaugauaggauacgaaacagacgaaaauagggccaaaguagaaguaacaccgaacucuccaagagcggaagcgacauuagggggauucggaucauuaggauuagauugugaaccaagaacaggauuagauuuuagcgaucuauauuacuuaacaaugaauaacaaacauuggcuaguacauaaagaaugguuucaugauauaccucuaccauggcaugcaggagcagauacugguacgccacauuggaacaauaaagaagcauugguagaauuuaaagaugcacaugcuaagaggcaaacgguuguaguacucggaucacaagaaggagcaguacauacugccuuagcuggugcacuagaagcagaaauggauggugcaaaaggaaaacuauuuaguggacauuuaaaaugucgacuaaaaauggacaaacuaagacuaaaaggaguuucauauucuuuaugcacagccgcauuuacauucacaaaagucccagcagaaacacuucacggaacagugacaguugaaguacaauaugcaggaacggauggaccguguaaaauaccuguacaaauggcaguagauaugcaaacacuaacaccaguaggaagauugauaacagcaaacccaguaauaacagaaucaacagaaaacucaaaaaugauguuagaguuggauccgccauucggagauaguuauauuguuauaggaguaggcgacaagaaaauaacucaucauuggcauagaucaggaagcacuauagguaaagcguucgaggcaacggugagaggggcuaaaagaauggcaguauuaggagauacagcaugggauuuuggaaguguaggaggaguauucaacucacuaggaaaaggaauacaucaaauauuuggagcagcuuuuaaaucacuauucgguggcaugagcugguuuucacaaauauuaauaggcacacuauuaguaugguuaggacuaaacacaaaaaauggaaguauaagucuaacauguuuagcacuaggaggaguaaugauauuucuaucaacagcagugagugcugauguagguugcaguguugauuucucgaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4785 - RNA, 2359 nt, Artificial Sequence
  KX694534.2 prME-long mRNA Design 1 opt
gggagaaagcuuaccaugagaauaauaaaugcaagaaaagaaaagaaaagacguggagcugauacaucaguaggaauaguaggauuacuauuaacaacugcgauggccgcagagguaacacgaagaggaucagccuacuauauguaucuggacagaaaugaugcaggagaagcaauaaguuuuccaacuacauuagguaugaauaaauguuauauacaaauuauggacuuaggacauaugugcgaugcuacaaugucauacgaaugcccaauguuagaugaagguguagaacccgacgauguugauuguugguguaacacaacaaguacauggguaguuuacgggaccugucaccauaagaaaggagaagcgagaagaucaaggagagcagucacucugccaagccacucuacaagaaaauugcaaacaagaagucaaacauggcuagaaaguagggaauacacaaaacauuuaaucagaguagaaaacuggauauuuaggaauccaggcuuugcacuagcagcagcagcaaucgcuugguugcuagguagcaguacaagucagaaaguaauauauuuaguaaugauuuuauuaauagcaccagccuauucaauucgauguauaggugucagcaauagagauuuuguagaaggaaugucuggcggaacauggguugauguaguacuugaacauggaggaugugugacaguaauggcucaagacaaaccaacuguagacauagaauuaguaaccacuacuguaaguaauauggcagaaguaagaaguuauuguuaugaggcuucaauaucagauauggcaucagacucaagauguccaacacaaggagaagcauaucuugacaaacaaucagauacgcaauauguauguaaaagaacucuagucgauagaggaugggguaacggauguggauuauucggaaaagguagcuugguaacuugugcaaaauuugcauguaguaagaaaaugacagggaaaaguauacaacccgaaaaucuagaauaucgaauaauguuaagugugcauggaucgcaacauaguggaaugauaguaaaugauacaggacaugaaacagaugaaaauagagcuaaaguagaaauaacaccaaauucaccgagagcagaagcaaccuuaggaggguuuggaaguuugggauuagauugugaacccagaacaggcuuagacuuuucagaucuauauuaccuaacuaugaacaauaaacauugguuaguacauaaagaaugguuucaugauauaccuuuaccauggcaugcaggagcagauacugguacaccgcauuggaauaauaaagaagcauuagucgaauuuaaggaugcacacgcaaaaagacaaacaguaguaguacuaggaucucaggaaggcgcagugcauacagcacucgcuggugcauuagaagcagaaauggauggagcaaaaggaagauuaagcucgggacaucuaaaauguagauuaaaaauggacaaauugagauuaaaagguguaagcuacaguuuaugcacagccgccuucacauucacaaaaauaccugcagaaacauuacauggaaccguuacgguagaaguacaauacgcaggaacagauggaccauguaaagucccagcacaaauggcaguagauaugcaaacauuaacaccaguagguagauugauaacugcaaauccaguaauuacggaaucgacagaaaauaguaaaaugaugcuagaauuagauccaccauucggcgauaguuauauaguaauaggaguuggagagaaaaagauaacacaucacuggcaucgaagugguucaacaauaggcaaagcauucgaagcaacagucagaggagcaaaaagaauggcuguauuaggcgacacagcgugggacuucggaaguguagguggagcacuaaauucauuaggaagaggaauacaucaaauauuuggagcagcauuuaaaucacuauuuggagguaugagcugguuuagucaaauauuaauuggaacauuauuaaugugguuaggacuaaauacuaaaaaugguucuauaaguuuaauguguuuagcacuaggaggaguacuaauuuuucucaguacagcuguaucagcagauguugguuguucaguugauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4786 - RNA, 2359 nt, Artificial Sequence
  KX447520.1 prME-long mRNA Design 1 opt
gggagaaagcuuaccaugagaauaauaaacgcacgaaaagagaaaaagagaagaggcgcagaugccagcguaggaauaguaggauuacuacuaacaacugcaauggcagccgaagucacucgaagaggaagugcauauuauauguauuuagauaggaaugaugcaggggaagcaauaucauuccccacaacauuaggaaugaauaaaugcuacauacaaauaauggauuuaggacauaugugugacgcaacgaugucauacgaauguccuauguuagacgagggaguugaaccagaugacguagauugcuggugcaauacaacaucaacauggguuguauauggcacuugucaccauaagaaaggagaagcgagaagaucuaggagagcaguaacacuaccaucacauaguacgagaaaacuacaaacaagaucucaaacaugguuagaaucaagagaauauacaaaacacuuaauaagaguagaaaacuggauauucagaaacccaggauucgcauuagcagcagcagcaauugcgugguuacuaggaaguaguacaagccaaaaaguuauauaucuugucaugauucuauuaauagcaccagcauauaguauuaggugcauaggcguuagcaacagagauuucguagaagggaugucaggaggaacauggguagauguuguauuagagcaugggggaugugucaccguaauggcacaggauaaaccuacaguagacaucgaauuaguuacaacaacaguaucaaauauggcagaaguaagaucuuauugcuaugaagcaucaauaucagacauggcuagugauagccgaugcccuacacaaggagaagcauacuuagauaaacaaucagauacacaauauguauguaaaagaacccuaguagauagaggauggggaaauggauguggauuauucggaaaaggaucauugguaacuugugcaaaauuugcauguucaaagaaaaugacuggaaaaagcauacagccugaaaaucuugaauacagaauaaugcuuaguguacacggaucucaacauucagggaugauaguaaacgauacagggcaugaaacagaugaaaauagagcgaaaguagaaauuacaccuaauagucccagagcugaagcaacacuaggaggauucggaagccuaggacuugauugugaaccccguacaggauuagauuuuucagacuuauauuauuugacaaugaacaauaaacauuggcuaguccacaaagaaugguuccacgacauaccgcuacccuggcacgcaggagcggacacugguaccccacauuggaauaauaaagaagcauuaguagaguucaaagaugcacaugcuaaacgacaaacaguaguaguacuuggaagucaagaaggagcaguacauacagcauuagcgggugcacuagaagcagaaauggauggagcaaaaggaagauuaaguagugggcaucuaaaaugcagacucaaaauggauaaacuaagguuaaaaggaguaucauauucauuauguacagcagcuuuuacauuuacuaaaauaccugcagaaacguuacauggaacgguaacugucgaaguacaauaugcuggaaccgacggaccaugcaaaguaccugcacaaauggcaguagauaugcaaacauuaacuccuguaggcagauugauaacugcaaacccugucauaacggaaucaacagaaaauaguaaaaugaugcuugaauuagacccaccauuuggagauaguuauauaguaaucggaguaggggaaaagaaaauaacacaucacuggcacaggucggggucaacaauaggaaaagcguuugaagcaacaguaagaggagcaaaaaggauggcaguauuaggugacacagcuugggauuuuggaagcguagguggugcauuaaauaguuuaggaaaaggcauucaucaaaucuucggagcggcauuuaaaagucuauucggaggaaugucuugguuuucucaaauacuuauuggaacuuuauuaauguggcuaggauuaaauacuaaaaacgguaguauaaguuuaaugugccucgcauugggaggaguauuaauauuucucaguacagcgguaagcgcagacguaggguguagcguagauuucucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4787 - RNA, 2359 nt, Artificial Sequence
  KX369547.1 prME-long mRNA Design 1 opt
gggagaaagcuuaccaugagaaucauaaaugcucggaaggaaaaaaaaagaagaggagccgauacaagcguaggaauaguaggauuacuucuaacgacagcgauggcggcagaggucacaaggagaggauccgcauauuacauguacuuggauagaaaugaugcaggagaagcaauaucauuuccaacaacacuaggaaugaacaaauguuauauacaaauaauggaucuaggacauaugugcgaugcuacaaugucauaugagugcccaauguuggaugaaggaguagagccagaugauguagacuguugguguaacacaacaucaacuuggguuguauacgggacgugucaucauaaaaaaggggaggcgaggaggucgagaagagcaguaacguuaccaucacauagcacaagaaaauuacaaacacgaagucaaaccuggcuagaaaguagagaauauacaaaacauuuaauuagaguagaaaauuggauauuuagaaacccaggauuagcguuagcugcagcagcaauagcauggcuuuuagguagcucgacaagucaaaaaguuauauaucucguuaugauacucuuaauagcaccugcauauaguauaagauguauuggaguaaguaaucgagacuuuguagaagguaugucaggaggaacaugggucgaugugguacuggaacauggaggauguguaacuguuauggcacaagauaaaccaacaguagacauagaguuaguaacaacaaccguaucaaacauggcagaagugcguaguuauugcuaugaagcgucgauaucagacauggcaagugauagccgauguccaacucaaggagaggcauauuuagauaaacaaagugauacucaauauguaugcaaaagaacacuagucgauagagguugggguaacggaugcggauuauucgggaaaggcucauuaguaacuugugcuaaauuugcuuguucaaaaaaaaugacuggaaaaagcauucaaccagagaauuuggaauaucguauaauguuaaguguucauggaucacaacacucagguaugauagucaaugauacaggacaugaaacagacgaaaauagggcaaaaguagaaauaacaccaaauaguccuagagcagaagcaacauuaggcggauuugggaguuuaggcuuagacugugagccaagaacuggauuagacuuuagcgacuuauauuacuuaacaaugaacaacaaacauugguuaguacacaaagagugguuucaugauauaccguuaccauggcaugcaggagcagacacuggaacaccacauuggaauaauaaagaggcauugguagaauuuaaagaugcccaugcgaaacgacaaacagugguaguacuaggaucacaagaaggcgcaguacauacagcacuugcuggcgccuuggaagcagaaauggacggggcuaaagguagauuaaguucaggucauuuaaaauguagauuaaaaauggacaaauuaagauuaaaaggugugucauauucauugugcacagcagcauucacauuuacuaaaauaccagcugaaacauuacacgguacaguaacaguagaaguucaauaugcagguacggacggcccauguaaagucccagcucaaauggcgguagauaugcagacauuaacuccaguugguagacuaauaacagcaaauccuguaaucaccgaaaguacugaaaauucaaaaaugauguuggaacuugauccaccauuuggagauucauauauuguaauagguguaggggaaaaaaaaauaacacaucauuggcacagaaguggaaguacgauuggaaaagccuuugaagcaacgguaaggggugcaaaacgaauggcaguauuaggugauacagcaugggauuuuggcaguguaggaggugcacuaaauucauuaggaaaaggaauacaucaaauauucggagcagcauuuaaaagcuuguuuggugguaugucaugguuuucacaaauacuaauaggaacacuauuaaugugguuaggauuaaauacaaaaaaugggaguauaagucucaugugucuggcauuaggcggaguacucauauuuuuaaguacagcaguuagcgcagauguaggauguaguguagauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4788 - RNA, 2359 nt, Artificial Sequence
  KX447515.1 prME-long mRNA Design 1 opt
gggagaaagcuuaccaugcgaauaauaaaugcacgaaaagaaaagaaaaggagaggagcugacacuuccguaggcauuguaggauuacucuuaacaacugcuauggcagcugaagucaccagaagagggucagcauauuacauguaucuugauagaaaugacgcaggggaagcaauuagcuuuccaacaacacuuggaaugaauaaauguuacauacaaauaauggaccucggacauaugugcgacgcaacuaugagcuaugaauguccaaugcuagacgaaggaguagaaccagaugacguagacuguuggugcaauacuacaaguacuuggguaguuuaugggacaugccaucauaagaaaggugaagcaagaagaucuaggagagcaguuacauuaccuagucauagcacgagaaaacuacaaacaagaucccaaacaugguuagaaucaagggaauacacaaaacaucuuauaagaguagaaaauuggauauucagaaaucccgguuucgcucuagcagcagcugcuauagcuuggcuauugggaaguagcacuagccaaaaaguaauauacuuaguaaugauacuauuaauagcuccugcauauucuauaagauguauuggaguaaguaacagagacuucguugaaggaaugaguggaggcacauggguagaugucguacuugaacacggaggauguguaacaguaauggcacaagauaaaccgacaguagauauugaauugguaacaacaacagucaguaauauggcagaaguuagaaguuauuguuaugaagcuaguauaagugacauggcaucagauucacgauguccuacacaaggagaggcuuaucuagacaaacagucugauacacaauacguguguaaaagaacuuuaguugaucgaggauggggaaauggauguggacuauuuggaaaaggaucauuaguaacaugugcaaaauucgcauguucaaagaaaaugacaggaaaaagcauacaaccagaaaauuuagaauacagaauaauguuaagugugcauggaucccaacacagcggcaugauaguaaaugauacaggacacgaaacagaugaaaacagagcaaaaguugaaauuacaccaaauaguccacgagcggaagccacacuuggaggguucggaucacuaggacuugacugugaaccaagaacuggauuagauuucucagauuuauauuacuuaacaaugaauaacaaacauugguugguacauaaagaaugguuucacgauauuccgcuaccauggcaugcuggagcagauacagggacaccacauuggaauaacaaagaagcucuaguagaauuuaaagaugcacaugcaaagagacaaacaguaguaguacuaggaagucaggaaggagcaguacauacagcacuagcaggagcucuagaagcugaaauggauggugcaaaaggaagacuaaguagcggacaucuaaaauguagacuaaaaauggacaaacuaagacuaaaggggguuucauauucauuauguacagcagcuuuuacauucacaaaaauaccugcagaaacuuuacaugguacaguaacaguugaaguacaauaugcuggaacagacggacccuguaaaguaccagcacaaauggcaguagauaugcaaacauuaacaccaguuggacgauuaauaacagcaaaucccguuauaaccgaaaguacagaaaauucuaaaaugauguuagaauuagaucccccauucggagacagcuauauagugauuggaguaggagaaaagaaaauuacacaucacugguaccgcucaggaucaacaauaggaaaagccuucgaagcuacuguaagaggugcaaaacgaauggcaguacuaggggacacagcgugggauuucgguucaguaggaggagcacuuaacuccuuagguaaaggcauacaucaaauauuuggagcagcuuuuaaaucucuauuugggggcaugucaugguucucacaaauuuuaaucggcacacuacuaaugugguuaggacuaaauacuaaaaacggaucaauaagucucaugugucuagcccuaggaggaguacuaauauuucuaaguacugcuguaucagccgaugugggaugcaguguagauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4789 - RNA, 2359 nt, Artificial Sequence
  KU501217.1 prME-long mRNA Design 1 opt
gggagaaagcuuaccaugagaauaauuaaugcacgaaaagaaaaaaaaagaagaggagcugauacaaguguaggcauaguagguuuacuguuaacuaccgcuauggcagcagaaguaacgagaagaggaucagcauauuauauguauuuagauagaaaugaugcuggggaagcaauaucauuuccuacaacauuaggaaugaauaaaugcuauauucaaauaauggaucugggacacaugugugaugcaacaaugucauaugaaugccccauguuagaugaagguguagaaccagaugauguagacuguugguguaauacaacaucaacuuggguaguauauggaacaugccaucauaaaaaaggagaagcgagaagaagcagaagagcuguaacauuaccaucacauaguacuagaaaacuacaaacaagaagccaaacauggcuugaaaguagggaauauacuaaacaucuuauaagaguagaaaauuggauauuuagaaauccaggauucgcauuagcagcugcagcuauagcauggcuauuaggaucauccacaagucaaaaaguaauauauuugguaaugauauuacuaauugcaccagcauacucaauaagauguauaggagucaguaauagagauuuuguggaaggaaugagcggaggaacauggguagacguaguuuuagaacacgguggaugcguuacaguuauggcacaagauaaaccaacuguagacauagaauuaguuacaaccacaguaaguaauauggcagagauuagaucauauuguuaugaagcauccauaagcgauauggcaucggauaguagauguccaacacagggcgaagcauaccuagauaaacaaagcgauacgcaauauguuuguaaaagaacgcuaguagauagaggaugggguaaugguuguggacuuuucggaaaaggaagccugguaaccugugcaaaauucgcauguucuaaaaaaaugacaggaaaaucuauucaaccagaaaaucuggaauauagaauaauguuaagcguccauggaagucaacauuccggaaugauuguaaaugauacgggacaugaaacagacgaaaacagagcaaaaguugaaauaacaccaaauuccccaagagcagaagcaacccuaggaggauuuggaucauuaggauuagauugcgaaccuagaacaggacuagacuucucagaccuguauuaccuaacaaugaacaauaaacauugguuaguacauaaagaaugguuccaugauauaccacuaccguggcaugcaggagcugacacuggaacaccccauuggaauaacaaagaagccuuaguagaguuuaaagaugcacacgcaaaacgacaaacaguagucguccuagguagucaagaaggugcuguacauacagcauuagcuggugcucuagaagcagaaauggauggagcuaaaggaagacuaucaaguggacaccuaaaaugccgauuaaaaauggauaaauuaagacuaaaaggaguaaguuacaguuuaugcacagcggcauuuacauuuacaaaaauacccgcagaaaccuuacaugguacaguaaccguagaaguacaauaugcaggcacggauggaccauguaaaguaccagcacaaauggcuguugauaugcaaacacuaacaccgguaggccgauuaauaacugcuaacccaguaaucacagaaaguacugaaaauaguaagaugauguuagaauuggacccaccauuuggagacucauauauaguaaucggcguaggagaaaaaaaaauuacacaucacuggcauagaucaggaaguacaauaggaaaagccuucgaagcaacuguaagaggagcaaagagaauggcaguacuaggagauacagcaugggauuuuggaucgguuggaggagcucucaauagcuugggaaaaggcauacaucaaauauuuggagcagccuuuaaaaguuuguucggaggaaugaguugguuuucucaaauauuaaucgggacacuacuaauguggcugggauuaaauacaaaaaauggcucaauaagucucaugugcuuagcuuuagggggcguuuuaauauuuuuaaguacagcaguaucagcagacguugguugcagcguagauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4790 - RNA, 2359 nt, Artificial Sequence
  KU312314.1 prME-long mRNA Design 1 opt
gggagaaagcuuaccaugagaauaauaaaugcccgaaaagaaaaaaaacgaagaggagccgacacaaguguaggaaucguaggguuauuacuuacgacggcuauggcggcagaaguaacacgaagaggaagugccuacuacauguacuuggacagaaaugacgcaggagaagcaauaucauuuccaacaacacuagguaugaacaaauguuauauucaaaucauggaucuaggucauaugugugaugccacuaugagcuacgaaugcccaaugcuugaugagggcguagaaccugaugauguggacuguuggugcaacacaacuaguacuugggucguguacggcacaugucaucauaaaaaaggagaagcaagaagaagcaggagagcaguaacguuaccgagccauucaacaagaaaacuacaaacaagaagccaaacaugguuagagagucgagaauauacaaaacacuugauaagaguagaaaacuggauauuuagaaauccagguuucgcauuagcagcagcagcaauugcauggcuauuggguaguuccacaagucaaaaaguaauuuauuuaguuaugauauuauuaauagcucccgcauacucaauaagaugcauaggaguaagcaauagagauuuuguagagggaauguccggaggaacguggguagauguagucuuagaacaugguggauguguaacuguaauggcacaagauaaaccaacuguagauaucgaacuuguaaccacaaccguaucaaauauggcagaaguuagaucguacugcuaugaggccucaauaucagauauggcaucagauucaagauguccaacacaaggugaagcauaucuugacaaacaaucugauacucaauauguauguaaaaggacacuaguagauagagguugggguaauggcuguggacuauuugguaaaggaucucuaguaacaugugcaaaauuugcauguucaaaaaaaaugacaggaaaaaguauacaaccagaaaaucuagaauacagaauaauguuauccguacaugggagccaacauagcggaaugauaguaaaugauacuggacacgaaacagaugaaaaucgagcaaaaguagaaauaacucccaauucaccuagagcugaagcaacccuaggagguuuuggaaguuuaggauuagauugugaaccacgaacaggucuagauuuuucagaucuauauuauuuaacaaugaauaacaaacacugguuaguacauaaagaaugguuucaugauauaccauuaccauggcacgcaggggcagacacaggaacuccccacuggaacaacaaagaagcuuuaguggaauuuaaagaugcacaugcaaaaagacaaacaguaguaguacuaggcucucaagaaggagcugugcauacugcauuagcaggagccuuagaagcagaaauggauggagcaaaagggagauugucaucagggcauuuaaaaugucgacuaaaaauggauaaauuaagauuaaaaggggucagcuauucacuauguacggcagcuuuuacauuuacaaaaauaccagcagaaacacuccaugguacaguaacaguagaaguucaauaugcagguacagauggaccauguaagguucuagcacaaauggcaguagauaugcaaacguuaacuccuguaggaagauuaauaacagccaauccuguaauaacagaaucaaccgaaaauucaaaaaugauguuagaauuagauccuccuuuuggagauucuuauauaguaauagguguuggugaaaaaaaaauaacacaucauuggcauagaaguggaagcacaauagguaaagcauuugaagcaacaguaagaggagcaaaacgaauggcuguacuaggagacacagcuugggauuucggaaguguaggcggagcauuaaauucauuaggaaaggguauacaucaaaucuuuggggcugcauucaaaaguuuauuugguggaaugagcugguucucacaaauucuuaucggaacacuauuaauguggcuaggucuuaauacaaaaaaugggucaauaucuuuaauguguuuagcauuagggggaguacuuauauuccucucaacagccguaucagcagacguuggauguucaguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4791 - RNA, 2359 nt, Artificial Sequence
  KX446950.2 prME-long mRNA Design 1 opt
gggagaaagcuuaccaugagaauaauaaaugccagaaaagaaaaaaaaagacguggugcugacaccaguguaggaauaguaggauuauuguuaacaacugcaauggcggcagaaguaacaagaaggggaagugcauauuauauguaucuagauagaaacgacgcaggcgaagcaauaaguuucccaacaacauuaggaaugaacaaauguuauauacaaauaauggaccucgggcacaugugcgaugcaacaaugaguuaugaaugcccaacacuagacgaaggaguugaaccggaugacguagauuguuggugcaacacaacaaguacguggguuguauaugguacgugucaucauaaaaaaggugaagccaggaggucaagaagggcaguaacauugccaucccauaguacacggaaauugcaaacaagaucacagacuuggcuugaaagcagagaauauacaaaacauuuaauaagaguagaaaauuggauauuucggaauccaggauuugcauuagcagcugcugcaauugcauggcuucuagguucgucaacaucacaaaaaguaauauauuugguaaugauauuguuaauugcuccagcauauucaauucguuguauagguguaagcaaucgugauuucguagaaggaaugagcggagggacguggguugaugucguguuagaacauggaggguguguaacaguaauggcacaagauaaaccaacaguagauauagaauuaguaacaacuacaguaagcaacauggcagaaguaagaucauauuguuaugaagcaaguauauccgacauggccuccgauaguagaugucccacacaaggugaagcguauuuagauaagcaaucugauacacaauacguaugcaaaagaacacuaguagauagagguuggggaaauggcugcggauuauuuggaaaaggcagucuaguuacaugcgcaaaauuugcauguagcaaaaaaaugacaggaaaaaguauucaaccagaaaacuuagaguauaggauaauguuaucgguacacggaagucaacacucaggaaugauuguaaacgacacgggccacgaaacugacgaaaauagagcaaaaguagaaaucacgccaaauucaccacgagccgaagccacauuaggaggauuuggaucacugggauuagauugcgaaccuagaacgggauuggauuuuagugauuuauauuauuuaacuaugaauaauaaacauugguuaguacauaaagagugguuucaugauauaccucuaccuuggcaugccggggcagauacuggaacuccacauuggaauaauaaagaagcauuaguagaauuuaaagaugcccacgcaaaaagacaaacaguaguuguauuaggaagucaggaaggagcuguacauacagccuuagcaggagcacuagaagcagaaauggauggagcaaaaggaagauuaucaaguggacacuuaaaauguagauuaaaaauggacaaacuaagacuuaaaggugugucauacuccuuauguacagccgcuuuuacuuuuacuaaaauuccagcggagacuuuacaugggacuguaacaguagaaguucaguaugcagguacagaugguccaugcaaaguaccagcccaaauggcaguugauaugcaaacauuaacaccaguaggaagauuaaucacagccaaucccguaaucacagaauccacagaaaauaguaagaugaugcuagaauuagacccaccguuuggagauaguuauauaguaauaggaguuggggaaaagaaaauaacacaucauuggcaccgaagcgguagcaccauaggaaaagcuuuugaagcaacaguuagaggagcuaaaagaauggcaguauugggugauacagcaugggauuucggaucaguagguggagcauuaaacagcuuggguaaaggaauacaucaaauuuucggagcagcauuuaaaagcuuauuuggaggaaugaguugguucucacaaauauuaauaggaacacuauuaaugugguuaggacuaaauacaaaaaauggaaguauaaguuuaauguguuuagcauuagggggaguacuaauauucuuaucaacagcaguaucugcugacguaggaugcucaguagauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4792 - RNA, 2359 nt, Artificial Sequence
  KY003157.1 prME-long mRNA Design 1 opt
gggagaaagcuuaccaugaggauaauaaaugccagaaaagaaaagaaaaggagaggagcagacacaagcguaggaauaguaggcuuauuauuaacaacagcaauggccgcagagguaacucgaagaggaucagcguacuauauguauuuagauagaaaugaugcaggagaagcaauaucauuuccaacaacauuaggaaugaacaaaugcuacauacaaauaauggauuuagggcauaugugugaugccacuaugaguuaugaaugcccaaugcuagacgaggguguggaaccagaugacguagauuguugguguaacacaacaucuacauggguuguauauggaacuugucaucacaagaaaggagaagcacgaagaagcaggagggcaguaacacuaccaagccauucaacuagaaaacuccaaacaagaagucaaaccugguuagaaucaagagaauauacgaaacaucuaauaagaguagaaaacuggauauuuagaaaucccggauuugcauuagcagcagcagcaaucgccuggcuauuaggaaguucaacaagucaaaaagugauauaucuagucaugauacuacuaauugcaccagcuuauagcauaagauguaucggugucagcaauagagacuucguugaagguaugucagguggaacguggguagacguuguuuuagaacacggcggauguguaacaguaauggcacaagauaaaccaacgguagacauagaacuugugacaacuacuguuaguaacauggcagaaguacgaagcuauugcuaugaagcaucuauaucagauauggcaucagauucacgauguccuacacaaggagaagcauacuuagauaaacaaagcgauacacaauauguuuguaaaaggacauuaguagauagaggcuggggaaaugguuguggauuauuuggaaaagguucauugguaacgugugcaaaauucgcuuguagcaagaaaaugacagguaaaucaauacaaccugaaaacuuggaauacagaauuaugcuaucaguacauggaucacaacauuccggaaugauaguaaaugauacuggucaugaaacagaugaaaaccgagccaaaguagaaauaacaccuaauucuccaagagcagaagcuacauuaggaggauucggaucacuuggucuagauugcgaaccaagaacuggacuugacuuuagugauuuauacuauuuaacaaugaauaauaaacauuggcuaguacauaaagaaugguuucaugacauaccauuaccauggcacgcaggagcagauaccggaacaccacacuggaacaauaaagaagcucuaguagaguucaaagaugcucaugcaaaaagacagaccgugguaguauuaggaucacaagaaggagcuguacauacggcucuagcaggagcacuugaagcggaaauggauggugcaaaaggacgauuaaguucagggcaucuaaaauguagauuaaaaauggacaaauuaagauuaaaaggaguaaguuauaguuuaugcacagccgcuuuuacauuuacuaaaauaccagcagaaacguuacauggaaccguuaccguagaaguacaauaugcaggaacagaugguccaugcaagguaccagcacaaauggcaguagauaugcaaacgcuaacaccaguaggaagguuaaucaccgcuaauccagugauaacagaaucgaccgaaaauuccaaaaugauguuagaauuggauccaccuuuuggagacuccuauauaguaauagggguuggggaaaagaaaauaacccaccauuggcauagaucagggucaacaauaggaaaggcuuucgaggcaaccgugcgaggagcaaaaagaauggcgguuuuaggggauacugcaugggauuuuggaagugugggaggagcauuaaacagccuggguaaagguauacaucaaauauucggagcagcauucaaaucauuauuuggaggaaugagcugguuuagucagauacuaauuggaacauuacugauguggcuuggauuaaacaccaaaaacggaucaauuagcuuaaugugcuuagcacuugguggaguauuaauauuccuaaguacaguaguuucagcagauguagguugcucaguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4793 - RNA, 2359 nt, Artificial Sequence
  KX811222.1 prME-long mRNA Design 1 opt
gggagaaagcuuaccaugagaauuauaaaugccagaaaagaaaaaaaaagaagaggcgccgauacaucaguagggauaguaggauugcuauuaacaacagccauggcagcagaaguuacaagacgaggaucagcauauuacauguacuuagauagaaaugaugcaggagaagcuauaaguuucccgacuacuuuaggaaugaacaaguguuauauucaaauuauggacuuaggacacaugugugacgcaacaaugucauaugaaugcccaauguuagacgaaggaguagaaccagaugauguagauuguugguguaacacuacaagcgcuugggucgucuacgggacaugccaccacaaaaaaggagaagcuagacgaaguagaagagcaguaacccuaccaucucauaguacacgaaaacuacaaacuagaccucaaaccugguuagaaucaagagaauacacaaaacauuuaauacgaguagaaaauuggauauucagaaacccaggauucgcguuggcagcggcggcaauugcaugguuauuaggaucaaguacaucucaaaaagucauauauuugguuaugauacuuuuaauagcuccagcauauagcauacgauguauaggaguaagcaauagagacuuuguggaaggaaugucaggagggacauggguugacguagucuuagaacauggaggauguguaacggucauggcacaagauaaaccaacaguugauauagaauuaguaacaacaacaguaucaaauauggcagaaguuagaucauauuguuaugaagcaucaaucucagacauggcaagugacucaagaugucccacgcaaggugaagcauaucuagacaaacaaagugauacacaauauguaugcaaaagaacacuuguagacagaggauggggcaacggaugcggucucuuugguaagggcagcuuaguuacaugugcaaaauucgcguguaguaaaaaaaugacagguaaaucaauacagccugaaaaucuugaauaucgaauuauguuaucuguucacggaucacaacauucuggcaugauuguaaaugacacaggucacgaaacagaugaaaacagagcuaaaguagaaauaacaccgaacucaccaagagcagaagcuacuuuaggagguuuugggaguuuaggacuagauugcgaaccaagaacaggacuugauuuuagugauuuauacuauuuaaccaugaauaauaaacauuggcugguacauaaagaaugguuucaugauauuccauuaccauggcaugcaggagcugauacaggaacaccccacuggaauaauaaagaagcgcuuguagaauuuaaagacgcacaugccaaaagacaaacaguaguaguuuuagguagucaagaaggggcaguccauacagcacuagcgggagcauuagaagcagaaauggauggagcaaaaggacgauuaagcucaggacaucuaaaauguagacugaaaauggauaaauuaaggcuaaaaggaguaagcuauagucuuugcacagcagcauucacuuuuacaaaaauuccagcggaaacacuacauggaacuguaacaguagaagugcaauacgcaggaacugauggaccguguaaaguuccagcacaaauggcaguagauaugcaaacauuaacaccaguaggacguuuaauaacagccaauccaguaauaacagaaucaaccgaaaacucgaaaaugaugcuagaauuagauccuccuuuuggagauucguacauaguuauaggugucggagaaaaaaagaucacacaucacuggcauagaagcggcaguacaauaggaaaagcauuugaagcuaccguacguggagcuaaaagaauggcaguucuaggcgauacugcaugggauuuuggcucaguuggaggugcauuaaacagcuuagggaaaggaauacaucaaauuuuuggugcagcauucaaaagcuuguuuggaggaaugucaugguuuagccaaauauuaauuggaacuuuacuuaugugguuaggacuaaauacaaaaaaugguaguauaucauuaaugugucuugcauuagguggaguauugauuuuuuuaucaacagcaguaagcgcagauguaggauguucaguagacuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4794 - RNA, 2359 nt, Artificial Sequence
  KX447516.1 prME-long mRNA Design 1 opt
gggagaaagcuuaccaugagaauaauaaaugcacgaaaagagaaaaagagacgaggcgcagacacaaguguaggaauaguaggccuacuuuuaacuacagcaauggcugcagaaguaacgagacgagguuccgcauauuauauguaccuugacaggaaugacgcaggggaagcaauauccuuuccaaccacauuaggaaugaauaaauguuacauacaaauaauggaucuaggacauaugugugaugcaacaaugaguuaugaauguccaaugcuggaugaaggaguagaacccgaugacguagauuguuggugcaauacuacaucaacauggguaguauaugggaccugucaucauaaaaaaggagaagcaagaaggaguagaagagcagucacauugccgagucacucaacaagaaaauuacaaacaagaucccaaacauggcuugaaucuagagaauacacaaaacaucuuauaagaguugaaaauuggauuuucagaaaccccggauucgcgcuagcagcagcagcaauagcauggcuccuuggaucauccacaaguaaaaaaguaauauacuuagugaugauauuacuaaucgcaccagcauacaguauacguugcauaggaguaucaaaucgagauuucguugaagggaugucuggagguacauggguagauguuguacuagaacaugguggauguguuacaguaauggcgcaagacaaaccuacagucgauauagaacuaguaacaacuacaguaagcaauauggcagaaguccgaucauacuguuacgaagcaaguauaucugacauggcaagcgacagucgauguccaacacaaggagaagcauaucuagauaaacaaucugacacacaauauguuugcaaaagaaccuuaguugauagaggaugggguaauggguguggcuuauuuggcaaggguagucuuguaaccugugcaaaauucgcauguaguaaaaaaaugacaggaaaaagcauacaaccagaaaaucuagaauauagaauaauguuaucaguacaugguagucaacauucaggaaugauaguuaaugacaccggacacgaaacugaugaaaaucgagcaaaaguagaaauaacaccaaauaguccacgagcagaagcuacauuaggcggauuuggaucguuaggauuagauugugaaccaagaacuggauuagauuuuagugaucuauauuaccuaacaaugaauaauaaacacugguuaguacauaaagaaugguuucacgacauaccacuacccuggcacgcuggagccgauacuggaacaccacauuggaacaacaaagaagcacuaguagaguuuaaagaugcacacgcaaaaagacaaacaguaguaguauuaggaucacaagaaggcgcaguccauacagcacuagcaggagcauuagaagcggagauggacggagcaaaaggaagacuaaguucaggccauuuaaaaugcaggcuaaaaauggauaaauuaagauuaaaaggaguaucauauucacuauguaccgccgcauuuacauuuacaaaaauaccagcagaaacuuuacauggcaccguuacugucgaaguccaauaugcuggaacagauggaccauguaagguuccagcucaaauggcaguggauaugcaaacacuaacuccaguagguagacuaauaacagcaaauccgguaauuacugaaucaacagaaaacucaaaaaugaugcuagaauuagauccuccguucggagacucguacauaguuauagguguaggugaaaaaaaaauaacacaucauuggcauagaucaggaucaaccauagggaaagcuuuugaggcuacgguaagaggagcaaaacgaauggccguuuuaggagauacugcaugggauuuuggaagcguaggaggagcauuaaacucauuaggaaaaggaauacaucaaauauuuggagcagcauuuaaaagucuauuuggaggaaugucaugguuuucacaaauacuaauaggaacucuguuaaugugguuaggacuaaauacaaaaaauggaucuauaagccuuaugugccuagcucuaggaggaguuuuaauauucuuaaguacagcuguaucagcagauguuggauguucuguagacuucucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4795 - RNA, 2359 nt, Artificial Sequence
  KX520666.1 prME-long mRNA Design 1 opt
gggagaaagcuuaccaugagaauuauaaaugcacgaaaagaaaagaaaagaagaggcgcugauacaagcgugggaauugugggauuauuauuaacaacagcaauggcagcggaaguuacaagaagaggaagugccuauuauauguaucuagauagaaaugacgcaggagaggcaaucucauuuccaacuacacuuggaaugaauaaauguuacauccaaauaauggacuuaggacauaugugcgaugcaacuaugucauacgaauguccgauguuagaugaaggaguagagccagacgauguagauugcugguguaauacaacuucaacauggguaguauacggcacgugucaucauaagaaaggcgaagcuagacgauccaggagagcaguaacauuaccuucacauaguacaagaaaauuacagacaagaucacaaacaugguuagaaucuagagaauauacaaaacaucuaauuagaguugaaaacuggauauuuagaaacccaggauucgcacuagcagcugcagcaauagcaugguuacuaggcagcucuacgagacaaaaaguaauauaccuuguuaugauacuccuaauagcaccagccuauucaauuagaugcauaggaguaaguaacagagauuuuguugaaggaaugagcggagguacauggguagauguaguauuagaacauggaggaugugugacaguaauggcacaggauaaaccaacuguagacauagaauuaguaacaacaacuguaagcaauauggcagaaguaagaaguuacuguuaugaagccucaaucagcgauauggcaagugauucaagauguccaacacaaggugaggcuuauuuagauaaacaaagcgacacacaauauguaugcaaaaggacauuaguagacagaggauggggaaacgguugcggccuauucggaaaaggaagucuaguuacaugugcaaaauuugcuuguucuaagaaaaugacaggaaaaagcauacagcccgaaaaccuagaauaucgcauaauguuaagcguacauggaucacaacauaguggaaugauaguuaaugauacaggacacgaaacagaugaaaacagagcaaaaguggaaauaacuccaaauucacccagagcagaagcaacacuaggaggauucggaucacuaggacuagauugugaaccgaggaccggauuggauuuuagugauuuguacuauuugacuaugaauaacaaacauuggcuaguacacaaagaaugguuucaugauauaccauuaccauggcaugcaggagcagauacggguacaccacauuggaauaacaaagaagcauuaguagaauuuaaagacgcacaugcaaaacgacaaacaguaguaguacuugggagucaggaaggagcaguacauacagcauuagcaggagcauuagaagcagaaauggauggugcaaaagguagacuuucauccggacaccugaaaugucgacuaaaaauggauaaauuaagauuaaaaggggugagcuacagcuuguguacugcagcauuuacuuuuacuaaaauaccagcugaaacacuucauggaacaguaacuguagaagugcaguaugcaggaacagaugguccauguaaaguaccagcacagauggcuguagauaugcaaacucuaacaccuguuggcaggcuaauaacugcaaauccaguaauaacagaaucaacagaaaacucaaaaaugauguuggaauuagauccaccauuuggagauaguuacauaguaauagguguuggggaaaagaaaauuacucaucauuggcacagaucaggaucuacgauaggaaaagcauuugaagcuacuguaagaggcgcaaaaaggauggcaguauuaggugauacggcaugggacuuuggaucuguagguggagcguugaauagucuagguaaaggaauacaucaaauauuuggagcagcauuuaaaucauuauuugguggcaugaguugguuuagucagauacuuauaggaacucuauuaaugugguuaggauuaaacaccaaaaauggaucaauaucacuuauguguuuagcauuagggggaguccuaaucuuccuaucaacagcaguaagcgcggauguaggauguucaguagauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4796 - RNA, 2359 nt, Artificial Sequence
  KU729218.1 prME-long mRNA Design 1 opt
gggagaaagcuuaccaugcguauuauaaaugcaagaaaagaaaagaaaagaagaucagcagauacaucaguugguauugugggcuuacuucucacaacagcgauggcagccgaaguaacuagaagaggaucagcuuacuacauguauuuagacaggaaugacgcuggggaagcuauaucauuuccuacaacauuaggaaugaauaaaugcuauauacaaauaauggaccuuggacacaugugugaugcaaccaugagcuaugaauguccaauguuagacgaaggaguagagccagaugauguagacuguuggugcaauacuacuuccaccugggugguauauggaacaugccaccauaagaaaggugaagcaagaagaaguagacgagcaguaacacugccaucacacaguacaagaaaacuucaaacaagaagccaaacauggcuagaaaguagagaauauacaaaacauuuaauaagaguagaaaacuggauauuuagaaauccuggauuugcuuuagcugcugcagcaauagcauggcuauugggaagcaguacaagccaaaaagucauauaccuaguaaugauacuucuuauagcaccagcauauucaauaagauguauaggaguaucaaauagagauuuugucgaaggcaugaguggaggaacauggguagauguuguuuuagaacauggaggauguguaacaguaauggcacaagauaaaccaacaguagacauagaauuaguaacaacaacagucucaaacauggcagaaguaagaucauauuguuacgaagcaucaauuucagauauggcuucagauucaagauguccuacacaaggagaagccuaccuagauaaacaaagugacacucaauacguaugcaaaagaacucuaguagauagagguuggggaaacggauguggguuauuuggaaaaggaagccucguaacaugugcaaaauucgccugcaguaagaaaaugacaggaaaaagcauacaaccagaaaacuuagaauauagaauaaugcuuaguguacacgguucucaacauucaggaaugauaguaaacgauacaggccaugaaacagaugaaaacagagcgaaaguagaaauaacaccaaauucacccagagcagaagccacacuuggaggauuuggcucauuaggauuagauugugaaccacgaacaggacuagacuuuagugaucuauauuacuuaaccaugaauaacaaacacuggcuaguacauaaagagugguuucacgauauuccacucccauggcacgcaggagcagauacuggaacaccgcauuggaauaauaaagaagcccucguagaauuuaaagaugcacaugcuaaaaggcaaacggugguaguauuaggaagucaagaaggagccguacacacagcauuggcaggggcacuagaggcugaaauggacggagcaaaaggucgauuaucaaguggacauuuaaaauguagauuaaaaauggauaaauuaaggcuaaaaggaguaucguauucauuaugcacagcagcauuuacauuuacaaaaauuccggcggaaacacuacauggaacaguaacaguagaaguacaauaugcgggaacagacgguccauguaaaguaccugcacaaauggcaguagauacacaaacuuugacaccaguaggaagacuaauuacagcaaauccaguaauaacugaaucaacagaaaauucaaaaaugauguuagaauuagauccaccuuucggagauaguuacauaguaauuggagugggggaaaagaaaauaacccaccacuggcaccgaagcgguucaacuauaggaaaagcauuugaggcaacaguuagaggcgcaaaaagaauggcgguauuaggagacacagcaugggauuucggaucuguaggaggggccuuaaacucacuaggaaaaggaauacaucaaauauuuggagcagcguuuaaaucacuauuuggugggaugucuugguuuagccaaauacuuauaggcacgcuacuaauguggcucgguuuaaauaccaaaaauggaucuauaaguuuaaugugucuagcauuaggaggaguacuaauauuuuugaguacagcagugucagcugauguaggcuguucaguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4797 - RNA, 2359 nt, Artificial Sequence
  KU761561.1 prME-long mRNA Design 1 opt
gggagaaagcuuaccaugagaauuauaaaugcaagaaaagaaaaaaaaagacgaggagcagacacuaauguagguaucguaggacuauuauuaacgacagccauggcagcugaaguaacccgaaggggaucggccuauuacauguauuuagauagaaaugaugcaggagaagcaauaaguuuuccaacaacguuagguaugaauaaauguuacauacaaauaauggauuuaggucauaugugugacgcaacaaugaguuacgaaugcccaauguuagaugaagguguggaacccgaugacguugauugcuggugcaauacaaccucaacauggguugucuaugggacaugucaucauaaaaaaggagaagcaagaagaaguagaagggccguuacucuuccaagccauagcacaagaaaacuccaaacuagaucacaaacauggcuagaaaguagagaauacaccaaacacuuaauaagaguagaaaauuggauauuuagaaauccaggauuugcauuagcagcagcagcuauagcauggcuauuaggaucgucuacaagucaaaaaguaauauauuuaguuaugauacuacuaauagcaccagcauacagcauaaggugcauaggcguaucaaacagagauuuuguugaaggaaugucaggaggaaccuggguagauguaguguuagaacauggagggugcgugacaguaauggcccaagauaaaccaacaguugauauagaacuugucacgacaacagugucaaacauggccgaaguaagauccuauuguuacgaagcaucaauaucggauauggcauccgauagcagauguccuacacaaggagaagcauauuuagacaaacaaagcgauacacaauauguauguaaacgaacauuaguugacagagggugggguaauggguguggacuauucgguaaagguaguuuagucacuugcgcaaaauuugcauguucuaagaaaaugacaggaaaaucaauacaaccggaaaaccuagaauacagaauaaugcuaucagugcauggaucacaacauagcggaaugauaguaaaugacacuggucacgagacagaugaaaauagagcaaaaguagaaauaacaccaaauucaccaagagcggaagcaacauuaggagguuuuggaucauugggauuagauugcgaaccaagaacaggauuagauuuuucagaucuuuauuaucugacaaugaauaauaaacauuggcuagugcacaaagaaugguuccaugauauaccccuaccauggcaugcaggugccgauaccggaacaccacauuggaauaauaaagaagcauuaguugaauuuaaagaugcucacgccaaaagacaaacaguaguaguauuaggcucacaagaaggggcaguacauaccgcauuggcuggagcguuagaagccgaaauggacggugccaaaggaagacucucaaguggucauuugaaaugcagacuaaaaauggauaaauuaagauuaaaaggaguaucauauaguuuaugcacagcugcauuuacauuuacaaaaauaccagcagaaacucuacauggaacaguuacaguugagguucaauaugcaggaacagauggaccaugcaaagucccugcacaaauggcaguagacaugcaaacacugacaccuguaggaagauuaauaacugcaaauccgguaauaacagaaaguaccgaaaacucgaaaaugauguuagaacuugauccuccguucggagacagcuacauuguaauaggaguaggagaaaaaaaaauaacgcaucacuggcauagaucaggaucgaccaucggaaaagcauuugaggccacugugaggggagcaagaagaauggcaguauuaggcgauacagcuugggauuuugguucagucggaggagcauugaauaguuugggaaaaggaauacaucaaauauuuggagcagcauuuaaaucauuauuuggugguaugagcugguucucccagauauuaauaggaacacuauuaaugugguuagguuuaaauacuaaaaauggaaguauaucauuaauguguuuagcuuuaggaggcguacuaauauuuuuaucaacggcuguuucagcagaugugggaugcucaguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4798 - RNA, 2359 nt, Artificial Sequence
  KY317938.1 prME-long mRNA Design 1 opt
gggagaaagcuuaccaugaggauaauuaaugcuagaaaagaaaagaaaagaagaggagcagaaacaaguguaggaaucguugguuuauuauuaacaacugcuauggcagccgaaguaacaaggagagggagugccuauuacauguauuuagacagaaaugacgcaggagaagcaauuuccuucccaacuacuuuagguaugaacaaauguuauauacaaauaauggauuugggacauaugugcgaugcgacaaugaguuaugaauguccaaugcuagacgaaggagucgaaccugaugacguagacuguugguguaacaccacaaguacauggguaguauauggaacgugccaucauaagaaaggagaagcgagaagaaguaggagagccguaacauuaccaagucacagcacaagaaaauuacaaacaagaagucaaacaugguuagaaucaagagaauauacaaaacaccuaauaaggguagaaaacuggauauuuagaaauccaggauuugcauuggcagcagcagccauagcaugguuguuaggaucaaguacaagucaaaaaguaauauauuuaguaaugauauuauuaauagcaccagcauauucaauaagaugcauagguguaucaaauagagacuuuguagaagguaugaguggaggaacuuggguagauguaguuuuagaacacggaggaugcguaacaguaauggcucaagacaaaccaacaguagauauagaauuagucacuacaacaguaucaaauauggcagaagucagaagcuauuguuacgaagcaagcauuucagacauggcaucugauucacguuguccuacgcaaggagaagccuauuuagauaaacaauccgacacacaauauguauguaaaagaacccuaguagacagagguugggguaauggauguggccuauucgggaaaggaaguuuagucacaugugcuaaauuugcaugcaguaagaaaaugacaggaaaaucaauacaaccggaaaaucuagaauacagaauaaugcuaaguguacauggaagucaacauuccggcaugauagugaaugauacugggcaugaaaccgaugaaaacagagcaaaaguagaaauaacaccaaauucuccgcgugcugaagcuacacuagggggauuuggaucauuaggucuugacugugaaccaaggacugguuuagauuucucggaucuauauuaucuaacuaugaauaacaaacauuggcuuguacauaaagaaugguuucacgauauaccacuaccauggcaugcaggagcagauacagggacuccucacuggaacaauaaagaagcauuaguugaguuuaaagaugcacaugcaaaaagacaaacuguaguuguauuaggcucacaagaaggugcaguacacacagcucuagcaggggcucuagaggcggaaauggauggugcaaaaggaagacuuucaaguggacacuuaaaaugcagacuaaaaauggauaaauugagauuaaaaggaguaaguuauucuuuauguacagcagcauucacauuuacaaaaauaccagcagaaacauuacauggaacaguaacaguugaaguacaauacgcgggaacagaugggccaugcaaagucccagcgcaaauggcuguagacaugcaaacgcugacacccguagggcgacuaauuacugcaaauccaguaauaacugaaaguacagaaaacaguaaaaugaugcuggaauuagaucccccguuuggagacagcuauauaguaauaggaguaggugaaaagaaaaucacacaucauuggcauagaucagguucaacaauaggaaaagccuuugaagcaacaguuagaggagccaaacggauggcagugcuuggagauacggcuugggacuucggaucaguaggaggcgcauuaaacaguuuagggaaaggaauacaccaaauuuucggugcagcuuuuaaaaguuuauuuggaggaaugucaugguuuucucaaauauuaauaggaacuuugcuaauguggcuaggauuaaacaccaaaaauggaucaauaucacugaugugucuagcucuaggugguguauuaauauuucuaucaacagcaguuucagcagauguuggaugcucaguugauuuuucgaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4799 - RNA, 2359 nt, Artificial Sequence
  KY075939.1 prME-long mRNA Design 1 opt
gggagaaagcuuaccaugagaauaauaaaugccagaaaagaaaagaaaagaagaggugcagauacauccguaggaauaguaggauuacuuuuaacaacagcaauggcagcagaaguaacaagaagggguucagcauauuauauguaccuagauaggaaugacgcgggagaagcuauaucauuucccacaacccuaggaaugaauaaaugcuauauacagaucauggaccuuggacauaugugugaugcaacaaugucauacgaauguccaauguuagaugaaggaguagaaccggaugacgucgauugcuggugcaacacuacgaguaccuggguagucuauggaacaugucaucauaaaaagggagaagcaagacgaaguaggagagcagucacuuugccaagucacaguacuagaaaacugcagacaagaagucaaacaugguuagaaucaagagaauauacuaagcaccuaauaagaguugagaauuggauauuuagaaacccagguuuugcucuugcagcugcggcuauagcguggcuguuaggaucaucaacaagucaaaaaguuauauacuuagugaugauauuauuaauugcuccugcauauucacuaagauguauuggaguaaguaauagagauuuuguagaagguaugaguggaggcacguggguugauguaguacuagaacauggcggauguguuacaguaauggcacaagauaaaccuacaguagauauagaauuaguaacuacuacaguaaguaauauggcagaaguuagaaguuacuguuaugaagcaaguauaucagauauggcaagugauucaagaugucccacgcaaggagaggcuuaucuagauaaacaaucagauacacaauacgucuguaaacgaaccuuaguagaucgagguuggggaaaugggugcgguuuauucggaaaaggaucauuaguaacuugugcaaaauuugcauguucaaagaaaaugacaggaaaaagcauccaaccagaaaacuuagaauauagaauaauguuaaguguacaugguucucaacauucaggaaugauaguaaacgacacaggccaugaaacagaugaaaauagagcaaaaguagaaauaacaccaaauucaccaagagcugaagcgacuuuaggaggauuugguagcuuagguuuagauugugaacccagaacaggauuggauuucagugauuuauauuaucuaacgaugaauaacaaacauugguuaguacauaaagaaugguuccaugauauaccauugccuuggcaugcuggagcagauacaggaacgccacacuggaauaauaaagaagcauuaguagaauuuaaagaugcacacgcgaaaagacagacaguagucguacuaggaucacaagaaggagcaguacauacagcauuggccggagcuuuagaagccgaaauggauggagcaaaaggcagauuaagcaguggccacuuaaaaugucgauuaaaaauggauaaauuaagauuaaaaggagucaguuacagcuuauguacagcugcauucacauuuaccaaaaucccagcagaaacauuacaugguacugugacaguagaaguacaauacgcuggaacagauggcccuuguaaaguaccagcacaaauggcaguagauaugcaaacauuaacaccgguaggaagguuaauuacugcaaauccaguaauaacugaaucaacagaaaauaguaaaaugaugcuagaauuagacccacccuuuggggauaguuauauagugauaggaguaggagaaaagaaaauaacacaccacuggcaucguagcggaaguacaauaggaaaagcauuugaagcuacgguaagaggggcaaaacgaauggcugugcuaggggacacagccugggauuucggaucagugggaggugcauuaaauucauuaggaaaagggauacaucaaauauucggagcugcguuuaaaucauuauucggaggaaugaguugguuuucucaaauauuaauuggaacgcuucuaauguggcuaggacuaaauacuaaaaacgguucaauaucucugauguguuuagcauugggaggaguacuaauauuccuuaguacagcaguaagugcggauguaggcugcucaguagauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4800 - RNA, 2359 nt, Artificial Sequence
  KX806557.2 prME-long mRNA Design 1 opt
gggagaaagcuuaccaugagaauuauaaacgcaagaaaagaaaaaaagagaagaggagcugacacuaauguaggaauaguaggacuguuauuaacaacagcgauggcagcagaaguaacgagaagaggaucugcauacuauauguauuuagauaggaaugaugcaggagaagccauaucauuuccgacaacauugggaaugaauaaauguuacauacaaauaauggaucuaggacauaugugugacgcaacaaugaguuacgagugucccauguuagaugaagggguugagccagacgauguggauuguugguguaacacaacaaguacuuggguuguauauggaacuugccaccauaaaaaaggugaagcuagaagaucacguagggcgguaacacuaccaucucacaguacccguaaacuacaaacgagaagccagacaugguuagaaagcagagaauauacaaaacauuuaauaagagucgaaaauuggauguuuagaaauccaggcuuugcauuagcagcagccgcuauagcauggcuucuuggaucaaguacaucacaaaaaguuauauauuuaguaaugauauuguuaauagccccagcuuacucaauaagauguauuggaguaagcaacagagauuuuguagaaggaaugaguggaggaacauggguugauguaguacuagagcauggugggugcguaacagucauggcgcaagacaaaccuacaguagauauagaauuaguaacaacaacaguaaguaauauggcagaagugcgaucauauuguuacgaagcaagcauuucugauauggcaucagauagucguuguccaacacaaggagaagcauaccuagauaaacaaucagauacccaauacguauguaaaagaacuuuaguagaucgagguugggguaauggauguggacuauuugguaaaggaagccuaguuacuugugcuaaguuugcaugcaguaaaaaaaugacagguaaaucaauacaaccagaaaaucuagaguauagaauaauguuaaguguacauggaagucaacauagugguaugauuguaaaugauacaggacacgaaacagacgaaaaccgagcuaaaguagaaaucacgccaaauagucccagggcagaagcaacauuaggaggauuuggcucguuaggauuagacugugaaccacgaacugggcuagauuuuagcgauuuauauuaucuaacaaugaacaacaaacacugguuaguacauaaagaaugguuucaugauaucccacuaccuuggcaugccggagcagacacaggaacaccacacuggaauaauaaagaagcacuaguagaguuuaaagacgcacaugcgaaaaggcaaacaguaguaguacuaggaucacaagaaggagcgguacauacggcacuagcuggagcccuagaagcagagauggacggcgcuaaaggaagauugagcaguggacaccuaaaaugucguuugaaaauggauaaauuaagacucaaaggaguaaguuauucguuaugcacagcugcguuuacauuuaccaaaauaccagcagaaacgcuacauggaaccguaacgguggaaguucaauaugcaggaacagauggaccaugcaaaguaccagcucagauggcgguagacaugcaaacauuaacaccaguagggagguuaauaacagcaaacccugugauaacugaaaguacagaaaauaguaagaugaugcuagaacuagauccaccauucggagauucauauauaguaauaggaguaggggaaaaaaaaauaacucaucauuggcauagaagugguaguacaaucggaaaagcauuugaagcaacaguacgcggggcaaaaagaauggcaguacuuggagauacagcaugggauuuuggaaguguaggaggugcguuaaauaguuuaggaaaaggaauacaucaaauauucggggcagcauucaaaaguuuauuuggaggaaugaguugguucagucaaauauuaauaggaacauuguuaauguggcuaggucuuaauacaaaaaaugguucaauaaguuuaaugugucuugcauuaggaggagucuuaauauuuuuaagcacagcaguaagugcggacguuggguguucaguugacuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4801 - RNA, 2359 nt, Artificial Sequence
  KU870645.1 prME-long mRNA Design 1 opt
gggagaaagcuuaccaugagaauaauaaaugcacgcaaagagaaaaaaagaagaggagcagauacaaguguaggaauaguugguuuauuacuaacaacagcaauggcagcugaagucacaagaagaggaucagcauauuauauguaccuagacagaaacgaugcuggagaagcgauaucauuuccuacgacacuugguaugaauaaaugcuauauucaaauaauggacuugggacauaugugugaugcaaccaugucauacgaaugcccuauguuagaugaggguguagaaccugacgauguagauugcugguguaacacaacuaguacuuggguaguuuauggaacaugucaccacaaaaagggagaagcaagaagaucaagaagggccguaacucucccaucacacaguacaagaaaauuacaaacaagaucacaaacgugguuagaaucaagagaauauacaaaacacuuaauaagaguugaaaauuggauacuacguaauccaggauucgcacucgcagcugcggcuauagcauggcucuuagguucgaguaccucucagaagguaauauacuuaguaaugauauuauuaauagcaccagcuuauucuauaagauguauaggagucaguaauagagauuuuguugaaggaaugucaggaggaacuuggguagacgugguacuggaacacggaggaugcgugaccguuauggcgcaagauaaaccaacgguagauauagaauuaguaacaaccacaguuaguaauauggccgagguaaggucuuauuguuaugaagccucuauaucugacauggcaucagacucaagaugcccuacacaaggagaagcauauuuagauaaacaaucagauacacaauauguauguaaacgaacacuaguagauaggggcugggguaauggaugcggacuauucggaaaaggaaguuuagucacaugugcaaaauucgcauguucuaaaaaaaugacaggaaaaucaauacaaccagaaaauuuagaauaucgaauuauguuaucaguacauggaucacaacauucuggaaugauaguaaacgacacaggccacgaaacagacgaaaauagagcaaaaguugaaauaacaccaaauaguccucgagccgaagcaacacuuggagguuuuggaagucuaggauuagauugugaaccaagaacaggauuagacuucucggaucuauauuaucugaccaugaauaauaaacauugguuagugcacaaagaaugguuucaugauauaccguuaccauggcaugccggagcagauacaggcacaccacauuggaauaauaaagaagcacuaguagaauucaaagaugcucacgcuaaaagacaaacagugguaguauuagguagccaagaaggagcaguacacacagcccuagcaggugcucuugaagcagaaauggauggagcaaagggaagauuaaguuccggacaccugaaaugcagacuaaaaauggauaaauuaagacuaaaaggagucucauauucauugugcacagcagcauuuacuuuuacaaaaauuccagcagaaacguugcacggaacaguaacuguagaaguacaauacgcaggaacagauggaccguguaaaguaccagcacaaauggcaguugauaugcaaaccuuaacaccaguuggaagauuaauaacugcaaacccaguaauaacagaaaguacggaaaauucaaaaaugauguuagaauuagauccuccauucggagauucauacaucguaauaggaauaggagaaaaaaaaauaacacaucauuggcacagaucgggaucaacaauagguaaagcauuugaagcuacaguaagaggagcaaaacggauggcaguauuaggagacacugccugggauuuuggaucaguagggggagcauuaaauucacuaggaaaaggcauccaucaaauauuuggugcugcuuuuaaaucccuauucggaggaaugagcugguucucacaaauacuuauuggaacucugcuaauguggcuaggauuaaauacaaaaaauggaagcauaagcuuaaugugucuagcucuaggaggcguucuaauuuuuuuaaguacagccguaucagcugacguaggauguucagucgauuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4802 - RNA, 2359 nt, Artificial Sequence
  KU729217.2 prME-long mRNA Design 1 opt
gggagaaagcuuaccaugagaauaauuaacgcuagaaaagaaaagaaaagaagaggagcugacacaagcgugggaauaguaggacucuugcuaacaacagcaauggcugcagaaguaacaagaagaggaagugcauauuauauguauuuggaucgaaaugacgcaggagaagcaauaucauuuccaacaacacucggaaugaauaaaugcuauauacaaauaauggaucucggacauaugugcgacgccacaaugucuuaugaauguccuaugcuagaugaaggaguagaaccagacgaugucgauuguugguguaauacaacaagcacaugggugguauacggaacaugucaucauaagaaaggugaagcaaggagaaguagacgggcaguaacacuaccaucacauaguacgcgaaaacuacaaacaagaucacaaacuuggcuagaaucaagagaauacacaaaacaucuaauuagaguagaaaacuggauauuuagaaacccaggcuucgcacuggcagcagcagcaauagcaugguugcuagggucaagcacaucacaaaaaguuauauauuuaguaaugauauuauugauagcuccagcauacaguauaagauguauaggagugucaaaucgagauuuuguugaaggaaugucaggaggcacuuggguagauguaguauuagaacauggugguugcguaacaguaauggcucaagauaaaccaacaguagauaucgaauuaguaucaacaacaguuucaaacauggcagaaguaagaucuuauuguuacgaagcaaccauaagcgauauagcaagugauucaagguguccuacacaaggagaagcauaucuagacaaacaaucagauacacaauacguaugcaaaagaacauuaguugauagaggauggggaaauggaugcggguuauuuggaaaagggaguuuaguaacuugugcaaaauuugcguguucaaagaaaaugacaggaaaaucaauacaaccagaaaacuuagaauaucgaauuauguugucaguacauggaucacaacauagcgggaugauagucaaugauacaggacaugaaacugacgaaaauagagcaaaaguagaaauaacaccaaauagcccuagagccgaagcuacauuaggaggauuugguucacucggacuagacugugaaccaaggacuggucuugauuuuucagauuuauauuacuuaacaaugaauaauaaacacugguuaguccacaaagaaugguuucaugacauaccauugccuuggcaugcaggagcagauaccggaacaccacacuggaauaauaaagaagcauugguagaauuuaaagacgcucaugcaaaaaggcaaacagcuguuguacucggaucucaagaaggagcaguucacacagcuuuagcuggagcacuugaagcagaaauggauggagcaaaaggaagacuaucuucgggccauuuaaaaugcagacuaaaaauggauaaauugcgauuaaaagggguuaguuacaguuuauguacagcggcuuuuacuuuuacaaaaauaccagcagaaacacuacauggaacaguaacaguagaaguacaauaugcggguacagauggcccaugcaaaguaccagcacaaauggcaguagauaugcaaacacuaacgccaguaggaaggcugauuacagcaaauccaguaauaacagaaucuacugaaaacucaaaaaugaugcucgaacuagauccaccauuuggggauucuuauaucguuauaggcguaggcgaaaagaaaauuacacaccauuggcacagaucaggaucaacaauaggaaaagccuuugaagcuacaguaagaggugcaaaaagaauggcuguucuuggagacacagcaugggauuuugguaguguagggggagcauugaacucacuagggaaaggcauacaucaaauuuuuggugcagcauuuaaaucauuauucggaggaaugagcugguuuagccaaauucuaauuggaacuuuacugauguggcuaggccuuaauacuaaaaauggaaguauaucacuuaugugcuuagcauuaggaggaguacugauauuuuuaucaacagccguuucagcagacguugguugcaguguugauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4803 - RNA, 2359 nt, Artificial Sequence
  KU497555.1 prME-long mRNA Design 1 opt
gggagaaagcuuaccaugagaauaauaaacgcucguaaagaaaaaaagagaagaggagcagacacaaguguaggcauaguaggauugcuuuugacuacagcaauggcagcagagguaacaaggagagggucagcuuauuauauguacuuagacagaaacgacgcaggugaagccauauccuuuccgacaacacuagguaugaauaaaugcuacauacaaaucauggauuuaggacauaugugcgaugcaacaaugagcuacgaauguccaauguuagaugaaggaguagaaccagaugauguugauuguugguguaacacaacuagcacauggguagucuauggcacaugucaccacaaaaaaggcgaagcuagaagauccagacgagccguaacauuaccuagucauagcacgagaaagcuacaaacaagaagccaaacaugguuagaaaguagagaauauacaaaacaucuaaucagaguggaaaacuggauauucagaaaccccgguuuugcauuagcugcagcagccauagcauggcuauuaggaaguucaacgagccaaaaaguaauauauuuaguaaugauauuacugaucgcuccagcauauucaauacgauguauagggguaagcaauagagacuucgucgaaggaaugucaggaggaacauggguagauguugugcucgaacacggugguugugucacaguaauggcacaagauaaaccaaccgucgauauagaacuaguaacaacaacaguuucaaauauggcagaaguaagaucuuacuguuaugaggcaaguauaagugauauggcgucagauucaagaugcccaacucaaggagaagcauauuuagauaaacaaagugauacacaauacguauguaaaagaacuuuaguagauagaggauggggaaauggcuguggucuauuuggcaaaggaagucuaguaacuugugcaaaauucgcaugcagcaaaaaaaugacaggaaaaagcauacaacccgaaaacuuagaauaucgaauaaugcugucaguccauggaagucaacacagugguaugauaguuaaugauacuggacaugaaacagacgaaaauagagcgaaaguagagauaacuccaaauucgcccagagcagaagcuacccuaggagguuuuggaucacucgguuuggauugcgaaccucgaacagguuuagacuuuagcgacuuauauuaccuaacaaugaacaauaaacauuggcuaguacacaaagaaugguuucaugauauaccuuuaccauggcaugcuggcgcagauacaggaacaccgcauuggaauaauaaagaagcacuaguagaauuuaaagaugcacaugccaaaagacaaacugucguuguauuagguacacaagaaggagcuguacauacagcauuagccggagcauuagaagcagagauggacggugcaaaaggccgauuaaguucagggcaucuaaaauguagauugaaaauggacaaauuacgacuaaaaggaguuucauauucauuauguaccgcagcauucacuuuuacaaaaauaccugcagagacauuacaugguacaguaacaguagaaguacaauaugcaggaacagacggaccauguaaaguaccugcucaaauggcaguagauaugcagacucuaacaccagucggcagauuaauaacagcaaaucccguaauaacagaaucgacggaaaauucuaaaaugauguuagaacucgauccuccauuuggagauaguuacauaguaauugggguaggagaaaaaaaaaucacucaucauuggcauagaaguggaucgacgauaggaaaagcauucgaagcaacaguacgaggagcuaaaagaauggcuguuuuaggugacacugcaugggacuuuggaucaguuggaggagcguuaaauagcuuaggaaagggaauacaucagauauuuggagcagcguucaaaagucucuucgguggaaugucaugguucagucaaauacugauagguaccuuauuaauguggcuaggauuaaauacaaaaaacgguuccauuagucuuauguguuuagcauuaggcggaguauuaauauucuuaucaacagcaguaucggcagacguaggauguaguguagauuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4804 - RNA, 2359 nt, Artificial Sequence
  KX087101.3 prME-long mRNA Design 1 opt
gggagaaagcuuaccaugagaauaauaaaugcccguaaagaaaagaaaagaagaggugcagauacaucaguggguaucguagguuuauuauuaacaacagcgauggcagcggaaguaacaagaagaggcucagcauauuauauguaccuagacagaaacgaugcgggagaagcaauaucuuuuccuacaacacuuggaaugaauaaaugcuauauacaaauuauggacuuaggacacaugugugaugcuacaaugagcuacgaauguccaauguuagaugaaggaguagaaccagaugacgucgauugcuggugcaacacuacgagcacauggguuguuuacgguacaugccaccauaagaaaggagaagcacgaagaucaagaagggcugucacguuaccgucacauucaacaagaaaauugcaaacaagaucacaaacaugguuagagucaagagaauauacaaaacauuuaauuagaguagaaaauuggauuuuuagaaauccagguuuugcacuugcagcagcugcuauagcaugguuauuaggaucaagcacaucacaaaaagucauauauuuagugaugauuuuacuaauugcacccgcauacagcauaagauguauaggaguaucaaauagagacuucguagaaggaaugucgggaggaacuuggguagauguaguauuagaacaugggggauguguaacaguaauggcucaggauaaaccaacuguugauauugaauugguaacaacaacagugaguaauauggcugaaguaagaaguuauuguuacgaagcaaguauaagugauauggcaagugauucaagguguccuacucaaggagaggcauacuuagacaaacaaucugacacucaauauguauguaaacgaacauuagucgaucgagguugggguaauggauguggucuauuuggaaaaggaucgcuaguaacaugugccaaauuugcauguaguaagaaaaugacaggaaaaaguauucaaccagagaacuuagaauaucgaauuauguuaucaguucauggaagucaacauaguggaaugauaguaaaugacaccggucaugaaacggaugaaaauagagcaaaaguugagauaacaccaaauaguccuagagcagaagcaacacuaggagguuucggaagucuagguuuagauugugaaccacgaacaggauuagacuuuagcgaucuauacuacuuaacuaugaacaauaaacacugguugguacacaaagaaugguuucaugacauaccacuaccguggcacgcuggagcugauacuggaacaccacauuggaauaauaaagaagcauugguagaguuuaaagaugcacacgcaaaaagacaaacaguaguaguauuaggaagccaagaaggagcaguacauaccgcauuggcuggugcauuagaggcagaaauggauggugcuaaagguagguuaaguucaggccauuuaaaauguagauuaaaaauggauaaauuaagacuaaaaggugucucauacagcuugugcacagcagcauucacauuuacaaaaaucccugcagaaacauugcauggaacgguaaccguagaauuacaauaugcaggcacagauggaccuuguaaaguaccagcucaaauggcaguagauaugcaaacuuuaacuccaguaggaagauuaauaacugcaaauccagugauaacggaaaguacugaaaacaguaaaaugauguuagaacuugauccgccauuuggagacagcuacauagugauaggugugggagaaaagaaaauaacccaucauuggcaccgaucaggaucaacaauaggaaaggcuuucgaagcaacaguuagaggcgcaaaacgcauggcuguauugggagauacugcaugggauuuuggaaguguagguggggcauuaaacaguuuaggaaaaggaauacaucaaauuuucggcgcagcauuuaaaucauuauucggaggaaugagcugguuuucacaaauacuuauaggaacacuacuaaugugguuagguuuaaauacuaaaaacggaaguauuucauuaauguguuuagcacucggagguguauuaauauuccuaucaacagcaguaucagcagacguaggaugcagcguagacuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4805 - RNA, 2359 nt, Artificial Sequence
  KY075932.1 prME-long mRNA Design 1 opt
gggagaaagcuuaccaugagaauaauaaaugcaagaaaagaaaagaaaagaagaggagcagaaacaaguguaggaaucguuggauuauuauuaacaacagcaauggcagcagaaguaacgagacggggaucagcuuauuacauguauuuggauagaaaugaugcaggagaagcuauuagcuuuccaacaacacuggguaugaauaaauguuauauacaaauaauggacuugggucauaugugcgacgcaacaaugucauaugaaugucccauguuagaugaaggaguagaaccagacgauguagauuguugguguaauacaacaaguacauggguaguauaugguacgugccaucauaaaaagggagaagcaaggagaucaagaagggcaguaacauuaccuagccauagcacucgaaaauuacaaacaagaagucagacgugguuggaaucaagagaguauacaaaacacuuaauacggauagaaaauuggauauucagaaacccagguuucgcucuggcugccgcagcaauugccuggcuauuagggucaagcaccucacagaaagugauuuacuuaguaaugauacuauuaauagcuccugcauacagcauuagauguauaggcguuucaaaccgagacuuugucgaaggaaugucgggagguacaugggucgauguaguauuagagcacggaggaugugugacaguaauggcacaagacaaaccaacagucgacauagagcuaguaacaacaacuguaaguaauauggcagaaguuagaucauauuguuaugaagccaguauaagugauauggcuagugauuccagauguccaacacaaggagaagcauaucuugauaaacaaagcgauacacaauauguuuguaaaagaacuuuaguagauaggggaugggguaacggguguggacuauuuggaaaaggaucuuuaguuacaugugcaaaauuugcauguaguaagaaaaugacaggaaaaucaauacaaccagaaaauuuagaauauagaauuauguugucaguacaugguucacaacauagugguaugauaguaaaugacaccgggcaugaaacagacgaaaauagagcaaaaguagaaauaaccccaaauagcccgagagcagaggcaacauuggguggauuuggaagccuuggacuagauugugaaccaagaacagggcuagauuucagugaccuguacuauuuaacaaugaacaacaaacauugguuaguccauaaagagugguuccaugauauccccuuaccauggcacgcaggagcagacacgggaacaccacacuggaacaauaaagaagcauuagucgaauuuaaagaugcacaugcaaaaagacaaaccguagugguauuaggaucacaagaaggugcaguucauacagcuuuagcuggagcacuugaagcagaaauggauggcgcaaaaggaagauuaucaaguggacauuuaaaauguagauuaaaaauggauaaauugagacuaaaagguguaucauacaguuuauguacagcagcauuuacuuuuacaaaaauaccugcagaaacauuacacgguacaguaacaguagaaguacaauaugcaggaacagacggaccaugcaaagucccggcacaaauggcuguagauaugcaaacacuaacaccagugggaagauuaauuacagcaaauccaguaauaacagaaucaacugaaaauucgaaaaugaugcuagaauuggauccaccauuuggagacaguuauauaguaauugguguuggcgaaaagaaaauaacacaucauuggcauagaucaggaucaacuauaggaaaagcauuugaggcuacagugcgaggagcuaaacgaauggcaguguuaggugauacggcaugggauuuuggaaguguaggcggugcccuaaauucacuuggaaaaggcauacaccaaaucuuuggagcagcauucaaaucgcuauuugguggaaugaguugguuuagucaaauauuaaucgggacuuuauuaaugugguuaggauuaaauacuaaaaauggaagcauaucacuaauguguuuagcguuaggaggaguauuaauuuucuuaagcacagccguaucagcagaugugggaugcaguguagauuucucgaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4806 - RNA, 2359 nt, Artificial Sequence
  KY014317.1 prME-long mRNA Design 1 opt
gggagaaagcuuaccaugagaaucauaaaugcuagaaaagaaaaaaaaagacggggagcagauacaucaguaggaauagugggauuauuacuaacaacugcaauggccgcagaaguuacacgaagagggagugcauauuauauguaucuagaccgaaaugaugcaggagaagcaauaagcuuuccaacaacccuuggaaugaauaaauguuauauacaaauaauggauuuaggacauaugugugacgcaacaaugucauaugaaugcccgauguuagacgaagggguagaaccagacgauguagacugcugguguaauacaacaucaacauggguuguauacggaaccugccaucauaaaaaaggagaagcaagaagaaguagaagggcgguaaccuuaccuucucauucaacuagaaaacuucaaacuagaucacaaacuugguuagaaaguagggaauauacaaaacauuuaauaagaguagagaauuggauuuuuagaaauccaggauuugcauuagcagcagcagcaauagcaugguuacucgguucaucaacaagucaaaaaguaauuuacuuaguaaugauuuuacuaauugcacccgccuacucaauuagauguauaggaguaucaaauagagauuucguagaaggaaugaguggaggcacuuggguugauguaguauuagaacaugguggcuguguaacagucauggcacaagauaagccaacaguagauauagaacuaguaacaaccaccguaucaaacauggccgaaguacgaucguacuguuaugaagcaucaauuagugacauggcaucagauaguagaugucccacacaaggagaagcauaucuagauaaacaaagugauacucaauauguauguaaaagaacauuaguagaucgagguugggguaauggauguggacuauuuggaaaaggaucucuagucaccugugcaaaauuugcuuguucaaaaaaaaugacaggaaaaagcauucaaccagaaaauuuagaauauagaauuauguuaucaguacauggaagccaacauucuggaaugauaguaaaugauacuggacacgaaacagaugagaauagggcaaaaguugaaauaacaccaaauucaccuagagcagaagcaacauuaggcgguuuugguagcuuggguuuggauugugaaccuagaacaggacuagauuuuagugauuuauauuaucuaacaaugaauaauaaacauuggcugguacauaaagaaugguuucaugauauaccauuaccuuggcaugcaggagccgauaccgguacgccucauuggaacaauaaagaagcacuuguagaauucaaagaugcacacgcaaaacgucaaacaguaguaguauuaggaucacaagaaggggcaguacauacggcguuagcaggcgcauuagaagcagaaauggauggagcuaaaggucgucuuucaaguggacauuuaaaauguagguuaaaaauggauaaacuacgauuaaaaggcguaucuuauucauuauguacagcagcauuuacuuuuaccaaaauaccagcagagacccuacauggaacagucacgguagaaguacaauaugcugguacugauggaccauguaaaguaccugcucaaauggccguagauaugcaaacauuaacaccagugggaagacuaauaacagcaaauccgguuauuacagaaagcauagaaaauucaaaaaugauguuagaacuagauccacccuucggugauucauauauaguuauaggcguaggggagaaaaaaauaacgcaucacuggcaucgaucaggaaguacaauaggcaaagcauuugaagcuacuguacguggagcaaaacgaauggccguucucggggacacugcuugggacuucggcucaguaggaggggcgcuaaauagucucggaaaaggcauacaccaaauuuuuggagcagcuuucaaaucauuauucggaggaaugucgugguucagucaaauauuaaucggaacacuacuaauguggcuaggacucaauaccaaaaaugggaguauaaguuuaaugugucuagcauuaggagguguuuuaauauuuuuaucaacugcuguuucagcagacguaggaugcucaguugauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4807 - RNA, 2359 nt, Artificial Sequence
  KU758876.1 prME-long mRNA Design 1 opt
gggagaaagcuuaccaugagaauaauaaacgcaaggaaagaaaagaaaagaagaggagcugauacaucuguaggaauuguaggguuacuauuaacaacagcaauggcugcggagguaacaaggaggggcucagcauacuauauguaucuagaccgaaaugaugcaggagaagcaauaaguuucccaacaacauugggaaugaauaaauguuacauacaaauaauggauuuaggccauaugugcgaugcaacaaugaguuaugaaugcccgaugcuagaugaaggaguugaacccgaugaugucgauuguugguguaauacaacaaguacuuggguaguauacggaacaugucaucauaagaaaggugaagcuagaagaucaaggagagcgguaacacuaccgucacauucaaccagaaaauuacaaacaagaucacaaaccugguuagaaaguagagaauauacaaaacauuuaauaagaguagaaaacuggauauuuagaaauccagguuuugcauuggcugcugcagcuauagcaugguuacuaggaagcucaacaagucagaaaguaauauaucuagucaugauuuuacuaaucgcaccagccuacaguauaagguguauaggaguaucaaauagagacuuuguagaagguaugaguggagguacauggguagacguaguacuagaacacggagguuguguaaccguaauggcccaagauaaaccgacaguagacauagagcuaguaacaacaacaguuucaaauauggcugaaguuagaagcuauugcuaugaagccucaauaagcgacauggcuagugauucaagaugucccacacagggagaagcauauuuagauaaacagucagacacucaauauguauguaagagaacauuaguagacagggguuggggaaauggauguggauuauucggaaaaggaagucuuguaacaugcgcaaaauuugcauguucgaagaaaaugacaggaaaaaguauacaaccagaaaacuuagaauauagaauaaugcuuaguguacauggaagucaacauaguggaaugauaguuaaugauacuggucaugaaacagaugaaaauagagcaaaaguagaaauaacuccaaacagcccuagagcagaagcuacauuaggaggauuugguaguuuaggacuagauugcgagccuagaaccgggcuggacuuuucugauuuauauuacuuaacaaugaacaauaaacauuggcuaguacauaaagaaugguuccaugauauaccuuugccauggcacgcaggggcagauacaggaacaccucauuggaauaacaaagaagcucuaguagaauuuaaagaugcacaugcaaaaagacaaacaguuguuguauuaggaagucaagaaggagcaguacacacagcacuagcaggagcauuagaagcagaaauggauggaguaaaaggccggcuuagcagcggucaucuaaaauguagauuaaaaauggacaaacuaagguuaaaagguguaaguuauagucuguguacugcggcauuuacauuuacaaaaauaccagcagaaacauuacaugguaccguaacaguagaaguacaauacgcaggaacggauggacccuguaaaguuccugcacaaauggcaguagacaugcaaacacuaacaccuguggguaggcuaauaacugcaaauccgguaauaacagaaucaacugaaaauaguaaaaugaugcuugaauuggaucccccuuuuggagacaguuauauaguaauagggguaggagaaaagaaaauaacucaccacuggcauagaagcggaucaacuauagggaaagcguucgaagcaacaguacgaggcgcaaaaagaauggcaguauuaggagacaccgcaugggauuuugguaguguaggaggugcacuuaauagccuaggcaaaggcauacaccaaauauucggagcugcauuuaaaucauuauuuggagggaugagcugguucucacaaauauuaaucggaacauuauuaauguggcuuggacuaaauaccaaaaauggaucaauaucauuuaugugucuagcacuuggcggaguauuaauuuuucuaaguacagcaguuucagcagacguaggcuguaguguagauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4808 - RNA, 2359 nt, Artificial Sequence
  KU758874.1 prME-long mRNA Design 1 opt
gggagaaagcuuaccaugcguauaauaaaugcacgaaaagaaaaaaaaagaagaggagcugacacaucaguuggaauuguaggauuauuauuaacuacagcaauggcagcagaaguaacaagacgaggaucugcuuauuauauguauuuagauagaaacgaugcgggagaagcaauaucauuucccacaacauugggaaugaauaaauguuacauacaaauuauggauuuaggacauaugugugaugcaacaaugagcuaugaauguccaaugcuagacgaaggaguugaaccugaugauguagacuguuggugcaauacuacaucaacaugggucguauauggaacaugccaucacaaaaaaggugaagcuagaagaaguagaagagcaguaaccuuaccaucccacaguacacgaaaacuacaaacaaggagucaaacaugguuagaaucaagagaauauaccaaacaucugauacgaguagaaaauuggauauucagaaacccaggauucgccuuggcagcugccgcgauagcauggcuacuaggaaguucaacuucacaaaaaguaauauacuuagucaugauacuacuuauugcgccagcauauagcauacgauguauaggagucagcaauagagauuuugucgaaggaaugucuggaggaacauggguagacguaguauuagaacauggaggauguguaacaguaauggcacaagauaaaccaacuguagauauugaauuaguuaccacaacaguaucaaauauggcagaaguaagaucauacuguuaugaagcaaguauaagcgauauggcaagugacucaagauguccaacccaaggagaagcauacuuagauaaacaaagcgauacacaauauguauguaaacgaacguuaguagacagaggauggggaaauggauguggucuauucggaaaagguaguuuagugacaugugcaaaauuugcuuguaguaaaaaaaugacaggaaaauccauucaaccagaaaaucuagaauauagaauaaugcugaguguacauggaucacaacacucugguaugauagucaacgacacuggacaugaaacugaugaaaauagggcuaaaguagaaauaacaccuaauucaccaagagccgaagcuacuuuaggugguuuuggcucauuaggcuuagauugugaaccacgaacaggauuagauuuuucagaccuauacuaccuaacaaugaacaacaaacauugguuaguucauaaagaaugguuucacgauauaccacuaccuuggcaugcaggugcagauacuggaacuccacauuggaauaacaaagaagcacuagucgaauuuaaagacgcacaugcaaaacgacaaacaguaguaguuuugggcucucaagaaggugcaguucauacagcacuagcuggugcucuagaagcagaaauggauggagcuaaggguaaacuaaguagcggacauuuaaaaugcagacuaaaaauggauaaauuacgacuaaaaggaguaaguuauucauuaugcacagcggcauucaccuuuacaaaaauaccagcagaaacauuacacggaacaguuacaguugaaguccaauaugcaggaacagauggaccauguaagguaccugcccaaauggcuguagauaugcaaacacuuacaccuguuggaagacuuauuacagcuaaccccguaauaaccgagucaacagaaaacaguaaaaugaugcuagaacuagaccccccauuuggugauaguuauauagugauagggguaggugaaaaaaaaauaacacaucauuggcauaggagcggaucaacaauagguaaagcauuugaagccacaguaagaggugccaaaagaauggcaguguuaggagacacagcaugggacuucggaucagugggcggugcacuaaacaguuuagguaagggaauacaucagauauuuggugcugcauuuaaaucuuuauuuggaggaaugaguugguuuagucaaauuuuaauuggaacacuauuaauguggcuagggcuaaacacgaaaaacggcucaauaucauuaaugugcuuagcauuagguggaguuuuaauauuucuaucaacagcaguuagugcugacguuggaugcuccguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4809 - RNA, 2359 nt, Artificial Sequence
  KY014314.1 prME-long mRNA Design 1 opt
gggagaaagcuuaccaugagaauaauaaacgcuagaaaagaaaagaaaagaagaggagcugauacaagugucgguaucguuggacucuuauuaacaacugcaauggccgcagaagugacacgaagggguagugcauauuacauguauuuagauagaaaugaugcaggagaagcgauaucauuccccacaacacuaggaaugaauaaaugcuauauacaaauuauggauuuaggucacaugugugacgcaacaaugucauaugaauguccaauguuagacgaaggaguagaaccagaugauguagauugcugguguaauacaacaucaacaugggucguauacggaacuugucaccacaagaaaggagaagcuaggagaaguagacgagcaguaacucuaccuagucauucuaccagaaaacuccaaaccagaucacaaacaugguuggaaucaagagaauauacuaaacaccugauaaggguagaaaauuggauauuucguaacccagguuucgcauuagcagcagcagcaaucgcaugguuauuaggaagcagcacaucacaaaaaguaauauauuuagugaugauauuacuaauagcgccugcauauaguauuagauguauaggaguaucaaaucgagacuuuguugaaggaaugucaggaggaacauggguagacguaguucuugaacacggaggauguguaacaguaauggcacaagacaaaccaacgguagauauagaauuaguaacaacgacaguaucaaacauggcagaaguaagaucuuacuguuacgaagcguccauaucagauauggcaagcgauucaagaugcccaacccaaggugaagcauaucuagauaaacaaagugauacacaauauguauguaaaaggacucuagucgacagagggugggguaauggauguggacuauuuggaaaaggaucauuaguaacaugugcaaaauuugcauguucaaagaaaaugaccggaaaaagcauccaaccagaaaaucuugaauaccgaauuaugcuaucaguacauggaucacaacacucaggaaugauaguaaaugacacaggucaugaaacagaugaaaacagggcaaaaguagaaauaacaccaaauucaccuagagcagaagcaacccucggagguuuuggaucauuaggauuagauugugaaccuagaacaggacuagauuuuucagacuuauacuacuuaaccaugaacaauaaacauugguuaguacacaaagaaugguuucaugacauaccuuugccauggcacgcaggagccgauaccggaacaccacacuggaacaauaaagaggcuuuaguagaauuuaaagaagcacaugcaaaacgacaaacaguaguaguauuaggaagucaagaaggggccguacacacagcacuagcaggagcauuagaagcagaaauggauggagcuaaaggaagacuaucaaguggacauuuaaaaugcagacuaaaaauggauaaacuaagacuaaaaggggucagcuacagucuauguacagccgcauuuacauuuaccaaaauaccagcagaaacacuacacggaacaguaacaguagaaguacaauacgcaggaacugacggaccauguaaaguacccgcacaaauggcaguagauaugcagacauuaacuccagucggcagauuaauaacugcaaacccugucauaacagaaaguacagaaaauucaaagaugauguuagaacuagauccacccuucggcgacagcuauaucguuauaggagugggagaaaagaaaauaacacaucauuggcaucgaucagguaguacaauaggaaaggcuuuugaagcaacaguaagaggugccaaaagaauggcuguacuuggagauacagcaugggauuuuggaucaguagguggugcuuuaaauaguuuaggaaaaggaauacaucaaauuuuuggagcagcauuuaaaucauuauuuggaggaaugucaugguucucacaaauauuaauaggaacucuauuaauguggcucggauuaaauaccaaaaaugggucaauaaguuuaaugugccuagcauuaggggguguauuaauauuuuuaucaacagcaguaagugcagauguuggauguucagucgauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4810 - RNA, 2359 nt, Artificial Sequence
  KU926310.1 prME-long mRNA Design 1 opt
gggagaaagcuuaccaugcgaauaauaaaugcuagaaaagaaaagaaaagaagaggagcagauacuucaguuggaauaguagguuuacuucucaccacugcaauggcagcagaaguaacacguagaggcucagcauacuacauguauuuagaucgaaaugaugcaggagaagcaauaucauucccaacaacacucggaaugaauaaauguuauauacaaaucauggauuugggacauaugugugaugccacuaugagcuacgaauguccuaugcuagacgaaggaguagaaccugaugauguagauuguugguguaacacuacaagcacauggguaguuuauggcacaugucaucauaagaaaggugaagcaagaagaucaagacgagcgguuacacugccuucucacucuacaagaaaacuacaaacaagaucacaaacuugguuagaaaguagagaauacacgaaacauuuaauaagaguagaaaacuggauuuucagaaaucccggauuugcuuuagcugcagcagcuauagcuugguuauuaggaagcaguacaagccaaaaaguaauauauuuaguaaugauucuacuuauagcuccagcauauucaauaagguguauaggaguuucaaauagagauuuuguagaaggaaugucagguggaacauggguagaugucguucuagaacauggcggaugcguaacagucauggcacaagauaaaccaacaguagauauugaauuaguaacaacaacuguaaguaauauggcagaaguaagaucguauugcuacgaagcaucaauaagugauauggcaucagacucaagaugcccaacacaaggagaagcauaucuagauaaacaaucagacacgcaauauguuuguaagcgaaccuuaguagauagagguugggguaacgggugcggauuauuuggaaaaggcagucuaguaacaugcgcuaaauuugcguguaguaaaaagaugacuggaaaaucaauucaaccagaaaaucuagaauauagaauaaugcugucaguacaugguucacaacauaguggaaugauaguaaaugacacgggucacgaaacagaugaaaauagagcgaaaguagaaauaacaccaaauagcccacgagcugaagcuacauugggagguuucgguucuuuagguuuagacugcgaaccgagaacaggauuagacuucagcgaucuauauuauuuaacaaugaauaauaaacacugguuaguacauaaagaaugguuucaugacauuccauuaccauggcaugcaggagcagauacagguacaccacauuggaacaauaaagaagcauuaguagaauuuaaagaugcacaugcaaaaagacaaacaguaguaguuuuagguagucaagaaggagcaguucacacagcacuagcuggugcauuagaagcugaaauggauggugcgaaaggaagacugaguuccggacaccuaaaaugcagacuaaaaauggacaaacuaagacuaaaagguguaucauacagcuuauguacagcagcauucacauucacaaaaauucccgcagaaacauuacauggaacaguaacaguugaaguccaguacgcgggugcagaugguccuugcaaaguacccgcccaaauggcagucgacaugcaaacuuuaacaccuguaggaagauugauaacagcaaauccaguaauaacagaaucaacagaaaacaguaaaaugauguuggaacuugauccaccauucggugacaguuacauaguaauagggguuggagaaaagaaaauaacacaucauuggcauagaaguggaagcacaauaggaaaagcauuugaagcaacaguaagaggcgcaaaacgcauggcaguacuuggagauacagcuugggacuuugggagcguuggaggagcccuaaacagucuuggaaaaggaauacaucagauauucggagcugcauucaaaagucuauuuggaggaaugucaugguuuagucaaauauuaaucgguacauuauuaauguggcuaggcuuaaauacgaaaaauggaaguauaagucuuaugugucuagcauuaggugguguacuaauauuuuuaaguacugcagugagugcagacguagguuguucaguugacuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4811 - RNA, 2359 nt, Artificial Sequence
  KU761560.1 prME-long mRNA Design 1 opt
gggagaaagcuuaccaugagaauuauaaaugcaggcaaagaaaaaaaaagacgaggugcagauacuaacgugggaauaguaggauuauuacuaacaacagcgauggcagccgaaguaacuagacgaggaagcgcauauuauauguaucuagaucgaaaugaugcgggagaagcaauaaguuucccaacaacauuaggaaugaacaaaugcuauauacaaaucauggaucuuggacacaugugugaugcaacaaugagcuaugaauguccaauguuagaugaaggaguugaaccugaugacguggauuguuggugcaacacgacaucaacauggguaguauauggaacaugccaucacaaaaaaggcgaagccagaagaagcagaagagcaguaacguuaccuagucauagcacaaggaaauuacaaacaagaagucaaacuuggcuugaaucaagagaauacacaaagcaucucaucagaguugaaaacuggaucuuucgaaauccaggauuugcuuuagcagccgcagccauagcaugguuacuaggaucaucaacaagucaaaaaguaauauacuuggucaugauacuacuaauugcaccagcuuauaguauacguugcauaggaguaaguaacagggauuuuguagaaggaaugucuggaggaacauggguugauguaguccuagaacacggaggauguguuacgguaauggcacaagauaaaccaacaguagauauagaauuaguaaccaccacaguuucaaauauggcagaaguacgaucguauuguuacgaagcuaguauaagugacauggcaucagauucaagaugcccaacacaaggagaagccuauuuagauaaacaaagugacacacaauacguauguaaaagaacacuaguagauaggggauggggaaaugguugcgguuuauuugggaaggguaguuuaguaacgugugcaaaauuugcauguaguaaaaagaugacuggcaaaagcauccaaccugaaaauuuagaauauagaauaauguuaucaguacauggaagucaacacucaggaaugaucguaaacgauacuggacacgaaacugaugaaaaucgagcaaaaguagaaauuacaccaaacucuccacgagcagaagcaacauuaggaggauuuggaucauuaggccuagauugcgaaccccgaacaggacuagauuucagcgauuuauauuauuuaacaaugaauaauaaacauugguuaguacauaaagagugguuucaugacauaccucuaccguggcaugcaggagcagauacugguacaccacauuggaauaauaaagaagcacuggucgaauucaaagaugcacaugcaaaacgacaaacaguaguaguauuaggcagucaagaaggagcgguacauacagcacuagcaggagcccuagaagcagaaauggacggugcaaaaggaagauuaaguaguggacaucugaaauguagauuaaaaauggauaaacuaagauuaaaaggagucucauauucauuauguacagcagcauuuacauuuacaaaaauacccgccgaaacauuacauggaacaguaacaguggaaguacaauaugcuggaacagauggaccuuguaaaguuccagcucaaauggcaguagacaugcaaacauuaacacccguagguagacuaauuacagcaaacccuguaauaacagaaagcacagaaaacucaaaaaugaugcuagaauuagaucccccauuuggugauaguuauauuguuauaggaguuggagaaaaaaaaauaacacaucauuggcacagauccgguucgacaauuggaaaagcauuugaagcuacuguaagaggugcaaggcggauggcgguauugggagacacugcuugggacuucggaucaguuggaggagcacuaaacucacuaggaaaagguauacaucaaauuuuuggugcagccuuuaaaucauuauucggaggcauguccugguucucacaaauacuaauagguacacuucuaaugugguuaggacuaaauacgaaaaauggaucaauaagcuuaauguguuuagcccuagggggaguccuaauauucuuaucaacugcaguaucagcagauguagguuguaguguagauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4812 - RNA, 2359 nt, Artificial Sequence
  KY317939.1 prME-long mRNA Design 1 opt
gggagaaagcuuaccaugagaauaauaaaugcaagaaaagaaaaaaaacgccgaggagcagaaacuaguguagggauaguagguuuacuuuuaacaacagcaauggcagcagaaguuacaagaagaggaagugcuuauuauauguauuuagaccgcaaagaugcaggagaagcaauaaguuuucccacaacguuggguaugaauaaauguuacauacaaauuauggacuuaggacacaugugcgaugcaacuaugagcuacgaaugcccuaugcuagaugaaggggucgaaccagaugacguugauuguugguguaacacaacaucaacauggguagucuaugguacaugccaucauaaaaaaggugaagcucgacgaucaagaagagcaguaacacuaccuagucauaguacuagaaaacuacaaacaagaagucaaacauggcuagaaaguagagaguauacaaaacaccuaauaagagucgaaaauuggauuuuuagaaacccaggauuugcauuggcggcagcugcuauugcaugguuacuaggaaguucaacuucacaaaaaguuauauaucuaguaaugauacuauuaauagcaccugcguauucaauuagauguauaggaguuucgaauagagauuuuguagaagggaugucagguggaacauggguagacguaguacuagaacacggaggauguguaacagucauggcacaagauaaaccaacaguugacauagaauuaguaacaacaacaguuaguaauauggcagaagucagaucauauugcuaugaagccagcauaucugauauggcaagcgacucaagauguccaacacaaggugaagcguaucuugauaaacaaucagauacccaauauguauguaagcgaacauuaguagauagaggguggggaaauggaugcggacuguuuggaaaaggaagucuagugacaugcgcaaaauucgcauguucaaaaaaaaugacaggaaaaagcauacaaccggaaaauuuagaauauagaauaauguuaaguguacaugguucacaacauaguggaaugauagucaaugauacuggacacgaaacagaugaaaaucgagcaaaaguugaaauaaccccuaauucaccaagagcagaagcuacauuaggagguuuuggaagucuaggauuagacugugaaccaagaacagggcuagacuuuagcgauuuauauuauuuaacaaugaauaauaaacauugguugguacauaaagaaugguuucacgacaucccacuaccguggcaugcuggagccgacacugguacaccacauuggaauaauaaggaagcauuaguagaauuuaaagaugcacacgcaaaaaggcaaacaguuguagucuugggcagucaggagggagcaguucauaccgcucuagcuggagcauuagaagcagaaauggauggagcaaaagguagauuaucaucuggacaccuaaaauguagacuuaaaauggacaaauugagacuuaaaggugucucauauuccuuauguacagcugccuuuacauuuacaaaaaucccagcugaaacauuacauggaacagugacaguggaaguacaauacgcaggaacagauggaccuuguaaaguuccagcacaaauggcaguugauaugcaaacacuaacaccaguuggcagauuaauuacggccaacccagugauaacagaaaguacagaaaauucaaagaugauguuagaacuagauccuccuuuuggagauucauauauugucauaggaguaggagaaaaaaaaauaacucaucauuggcauagaucaggaucaacaauaggaaaagcauucgaagcaacaguuagaggagcuaaaaggauggccguacuaggagacacagcaugggauuuuggaucagugggaggagcauuaaacucauugggaaaagggauacaccaaauuuuuggcgcagcauuuaaaucuuuauuugggggcaugucuugguucagucaaauauuaauuggaacacugcucauguggcuuggacuuaauacaaaaaacggaucaauaagcuuaaugugucuugcauuaggaggaguucuaauauuuuuaaguacugcaguaucugcagauguaggauguaguguggauuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4813 - RNA, 2359 nt, Artificial Sequence
  KY075937.1 prME-long mRNA Design 1 opt
gggagaaagcuuaccaugagaauaauaaacgcaagaaaggaaaaaaaaagaagaggagcagauacaaguguaggaauaguaggcuuacuacuuaccacagcaauggcugccgaaguaacaagaagaggaucagcauauuacauguauuuagauagaaacgaugcaggagaagcaaucucuuuuccaaccacacucgggaugaacaaauguuacauacaaauaauggacuuaggacauaugugugaugcaacuaugaguuaugaauguccuaugcuagaugagggggucgaaccugaugauguugauuguugguguaauaccacuagcacauggguaguguaugguacaugucaucacaaaaaaggugaagcaagaagaucaagaagagcaguaacauuaccaagucauagcaccagaaaauuacaaacaagaucgcaaacaugguuagaaaguagagaauauacuaaacaucuaauaaggguagaaaacuggauauuuagaaauccaggcuuugcauuagcagcggcugcaaucgcaugguuacuagguaguucaacaucacaaaaaguuauauaucuaguuaugauacuauuaauagcaccagcauacucaauaagaugcauaggaguaaguaauagagauuucguagaagguaugagugggggcacauggguugacguuguuuuagaacaugguggauguguuacuguaauggcacaagacaaaccaacuguagauauagaacuaguaacgacaacaguaucaaacauggcugaagugagaucauauuguuaugaagccaguauaagugauauggucagugauucaagauguccaacacaaggugaagcauauuuagauaaacaaucagacacucaauacguuuguaaaaggacucucguagacagaggauggggaaacggauguggauuauuugguaaagggucuuuaguaacaugcgcaaaauuugcguguagcaagaaaaugaccggaaaaaguauucaaccugaaaauuuagaguauagaauuaugcuaaguguacacggaagucaacauucagguaugauaguuaacgauacaggucaugaaacagaugaaaauagagcuaaaguagaaauaacaccaaauucacccagggcagaagcaacauuagggggcuucggaucauuaggacuagauugugaaccucgaacugggcucgauuuuagugaucuuuauuauuugacaaugaauaauaaacacuggcuugugcauaaagaaugguuucacgauauaccauuaccauggcacgccggagcggauacaggaacuccacauuggaacaacaaagaagcauugguagaauuuaaagacgcccaugcuaaaagacaaacagucguaguacuaggaucucaagaaggugcaguacauacagcgcuagcaggagcguuagaagcggaaauggauggugcuaaaggaagauuaagcagcggacaucugaaaugcagauuaaaaauggacaaauuaagauuaaaaggagucucauauucauuauguacagcugcauuuaccuucacaaaaauaccagcagagacuuugcaugguacaguaacaguagaaguacaauaugcuggaacagacggucccuguaaaguaccugcacaaauggcgguagauaugcaaacacuaacucccguaggaagacuaauaacagcuaauccgguuauaaccgaaaguacugaaaauagcaaaaugauguuagaauuggacccaccauuuggagauaguuauauuguuauagguguaggcgaaaaaaaaauaacucaccauuggcauagaagugguaguacaauaggcaaagcauucgaagcaacuguaagaggagcaaaaagaauggcuguacuaggcgauacagcaugggauuucgguagcguaggaggagcacuaaacucuuuagguaaagguauucaccaaauauuuggugcagcauuuaagucccuauucggaggaaugagcugguuuagucaaaucuuaauaggaacucuacuaaugugguuaggacuaaauacaaaaaaugguaguauaaguuuaaugugcuuagcacuuggaggaguauuaauuuuucuaagcacagcaguaucagcagacguuggaugcucuguagauuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4814 - RNA, 2359 nt, Artificial Sequence
  LC191864.1 prME-long mRNA Design 1 opt
gggagaaagcuuaccaugagaauuauaaaugcccgaaaagaaaagaaaagaagaggagcagauacaaauguagguauagucggccuacuacuaacaacagcaauggcagcagaaguuacacgccguggaucagcuuauuauauguaccuagauagaaaugaugcaggagaagcgauuaguuuuccgacaacauuagguaugaauaaauguuacauacaaauaauggaccugggacacaugugcgacgcuacaaugagcuaugaaugcccaaugcuagacgaaggaguagaaccagaugacguagacugcugguguaauaugacaucaacaugggucguauauggaacaugccaucauaagaaaggagaagcaagaagaucucggagagcgguaacucucccaagucauaguacuagaaaacuacaaacaagaucucaaaccuggcuagaaucaagagaauauacuaaacaucuaauaagaguagaaaauuggauauuuagaaacccugguuucgcccuagcagcugcugcaauagccuggcuacuaggaaguaguacaagccaaaaaguaauauauuuaguaaugauauuacucauugcuccggcguauaguauuagauguauuggaguaaguaauagagacuucguagaaggaaugucgggaggcacauggguagauguaguacuagaacauggaggauguguaacgguuauggcucaagauaaaccaacaguagauauagaauuagucacuacaacaguaucaaauauggcagaaguaagaucuuacuguuaugaagcaucaauaagugauauggcuagcgacucuagaugcccaacccaaggagaagcauacuuagauaaacaaucagauacacaauauguauguaaaagaacauuaguagacagaggguggggaaauggauguggauuauucggaaaaggaucccuaguaacaugcgcaaaauuugccuguucaaagaaaaugacaggaaaaucaauacaaccagaaaacuuagaauauagaauaauguuaaguguacacgguucacaacauucaggaaugauaguaaaugauaccggucaugaaacugaugaaaauagagcaaaaguggaaaucaccccaaauucaccaagggcagaagccacucuaggaggguuugguucacuaggacuugauugugaaccaagaacaggacuagauuuuucagauuuauauuauuuaaccaugaauaauaaacauugguuaguucauaaagaaugguuucaugauauuccccuuccauggcaugcaggagcagacacaggaacaccucauuggaacaacaaagaagcucuaguagaauuuaaagaugcacacgcaaaaagacaaacuguagucguucuaggaucacaagaaggagcaguacacacagcacuagcaggagcacucgaagcagaaauggauggagcaaaaggacgacuaagcaguggacauuuaaaaugucgacuuaaaauggauaaauuaagauuaaaaggaguaaguuacucauuauguacagcagcauuuacauucacaaaaauacccgcagaaacccuacauggaacaguaacuguggaaguccaauacgcuggcacagauggaccauguaaaguaccagcucaaauggcaguagacaugcaaacauuaacuccaguagguagauuaauaacugcaaauccugucauaacagaaucaacggaaaacuccaaaaugauguuagaacuagacccaccauuuggagacaguuauauaguuauagguguaggugaaaagaaaauuacacaucauuggcauagaaguggaucaaccauaggaaaagccuuugaagcaacaguaagaggagccaaaaggauggcaguacuuggagacacagcaugggacuuuggaagcguaggaggagcauuaaacagccugggaaaaggaauacaucaaauauucggagcagcauuuaaaagccuuuuuggagguaugucgugguucucccaaauccuaauuggaacucucuuaauguggcuaggacuuaauaccaaaaacggaucaauaucauuaaugugucuagcauuaggagguguacuaauauuucuaaguacagcaguaucagcagacguaggauguucaguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4815 - RNA, 2359 nt, Artificial Sequence
  KX447517.1 prME-long mRNA Design 1 opt
gggagaaagcuuaccaugagaauaauaaacgcuaggaaagaaaaaaaaagaagaggggcagacacaaguguagggauagucggacuauuauuaacuacagcaauggcagcagaaguuacaaggagagguucugcauacuauauguauuuagaucgaaaugacgcaggcgaggcuauaaguuuucccacaacucucggaaugaauaaauguuauauucaaauaauggaucuuggacacaugugugaugcaaccaugucauaugaauguccaauguuagaugaaggaguagagccagacgauguagacuguugguguaacacuacaucaacuuggguaguuuacggaacaugucaucauaaaaaaggagaagcgagaaggaguagaagagcaguaacauuaccuucacauucaaccaggaaauuacaaacaagaagccaaaccugguuagaaucaagagaauauacaaagcauuuaauacgcguggaaaacuggauauuuaggaacccaggcuucgcuuuagcagcggcugcgauagcauggcuccucggaucaucaacgucacaaaaaguaauauauuuaguaaugauuuuauugauagcaccagcauauucaauacgauguauuggcgugucaaaucgagauuuuguugaaggaauguccggaggaacuuggguagauguaguauuagaacauggaggauguguaacaguaauggcacaagacaaaccuacaguugauauagaauuaguaacaacaaccguaucaaauauggcagagguaagaagcuauuguuaugaagcuucaauaucagauauggcuucagauagcagauguccaacacagggagaagcuuaucuagacaaacaaucagacacacaauauguauguaaaaggacacuaguagauagagguuggggaaaugguuguggucuuuucgguaaaggaagcuuaguaaccugcgcaaaauuugcuuguaguaaaaaaaugacuggaaaaagcauucaaccagaaaauuuagaauauagaauaauguuaaguguacacggcucucagcauagcggaaugauaguaaaugauaccggccacgaaacugacgaaaauagagccaaagucgaaauuacuccuaauucuccaagggcugaagcugcauuaggugguuuuggaucgcuaggccuugacugcgaaccaagaacaggauuagacuucagugaucuauauuauuuaaccaugaauaauaaacacugguuaguccauaaagaaugguuccaugauauaccgcuaccauggcacgcaggugcagauacagguaccccacacuggaauaauaaggaagcauuagucgaauuuaaagaugcacacgcgaaaagacaaacaguaguaguauuaggaucacaagaaggggcuguacacacagcacuagcuggagcacuagaagcagaaauggauggugccaaaggcagauuaaguaguggacaucuuaaauguagacuuaaaauggauaaauuacgacuuaaagguguaaguuauucacuauguacagcagcauuuacuuuuacuaaaauuccagcagaaacacuucauggcaccguaacuguugaaguacaauacgcaggaacugaugguccuuguaaaguuccagcacaaauggcaguggauaugcaaacauuaaccccaguaggcagauugauaacugcaaauccgguaauuacagaaaguacagaaaacaguaaaaugaugcuugagcuugauccaccauuuggggacucuuacauaguaauaggagucggugaaaaaaaaauaacacaccacuggcacagaucagguucaacuauaggaaaagccuucgaagcuacaguaagaggugcaaaaagaauggcaguauuaggagauacagcaugggacuucggaucuguaggaggagcauuaaauucauuaggaaaaggaauacaucaaaucuucggagccgcauuuaaaagucuauucgguggaaugucuugguuuagccaaacauuaauaggcacuuuauuaauguggcuagguuuaaauacaaaaaaugguucaauuaguuuaauguguuuagcauuaggagguguacuaauauucuugaguaccgcaguaucagccgaugucgguuguucuguagauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4816 - RNA, 2359 nt, Artificial Sequence
  KU922923.1 prME-long mRNA Design 1 opt
gggagaaagcuuaccaugaggauuauaaacgcacgaaaagaaaaaaaaagaagaggggcagaaacaagcguaggaauuguaggucuacuauuaacaacagcuauggcugcugaaguaacacgaagaggaucagcauauuacauguauuuagauagaaaugaugcgggagaagcaaucucauucccuacaacguuagggaugaauaaauguuauauccaaauaauggaucuaggccacaugugcgaugcuacaauguccuaugagugcccaaugcuagaugaaggaguagaaccagaugauguagauuguugguguaauacaacaaguacauggguaguauaugguacaugucaccacaaaaaaggagaagcgaggcggucaaggagagcaguuacauuaccaucacacaguacaagaaaacuacagacacgaucacaaacaugguuggaaaguagggaauacacuaaacaucuaauacguguugaaaauuggaucuuuagaaacccaggguucgcucuagcagcggcagcuauagcaugguuacuagguucuucaacaucgcaaaaaguaauauaccucguaaugauucuacuaauagccuuagcuuacucaauaagaugcauaggcguauccaauagagauuuuguagaaggaaugucaggaggaacuuggguagauguaguuuuagaacacggaggcuguguaacaguaauggcacaggacaaaccuacaguagauauagaauuaguaacaacaacaguaucuaauauggcagaaguucgaucauauuguuaugaagcaucgauuucagauauggcaagcgauaguagauguccuacgcaaggugaagcauauuuagauaaacaaucugauacucaauauguaugcaaaagaacauuaguagauagggguuggggaaauggauguggacuauucggaaaaggaagcuuggucacuugugcaaaauuugcauguucaaaaaaaaugacaggaaaaucaauacaaccagaaaacuuagaauacagaauaaugcugagcguacauggaagccaacauagcggaaugauaguaaacgacacaggacaugaaacagaugaaaacagagcaaaaguagaaauaacucccaauucaccaagagcagaagcaacucucggaggauucggaagcuuaggacuagacugugaaccgagaacaggucuagacuucucugaucucuacuaucuaacuaugaauaacaaacauuggcuaguucauaaagaaugguuccaugacauaccauuaccauggcaugcuggagccgauacaggaacaccacauuggaacaauaaagaagcucuaguugaauuuaaagaugcacaugcaaaaagacaaaccgucguuguauuaggaucacaagagggagcuguccauacagcauuagcaggagcauuagaagccgaaauggauggagcaaaaggaagacuaucaucaggacauuugaaauguagauuaaaaauggauaaauuaagacuaaaagggguaucauacucacuauguaccgcagcauuuacauuuaccaaaauaccagcagaaacauuacauggaacaguuacaguggaaguccaauaugccggaacugaugguccaugcaagguacccgcccaaauggcaguagacaugcaaacacuaacaccagugggaagauuaauaaccgccaauccaguaauuacagaaucaacagaaaauucaaaaaugaugcucgaauuagauccgccauucggagauagcuacauuguuauuggaguaggagaaaaaaaaauuacacaccauuggcaccgaagcggaagcacuauuggaaaagcauuugaagcuacuguaagaggagcaaaacgaauggcaguacuuggagauacugcuugggauuuuggaaguguagguggcgcacuaaacagcuuagguaaaggaauacaucaaauauucggcgccgcauucaaaagcuuguuugggggaaugucaugguucucacaaauauugauagguacacuuuugauguggcuaggacuaaauacaaaaaacgguucaauaagucuuaugugucuagcccucgguggaguacuuauauuuuuaaguaccgcaguaagcgcagauguuggcuguaguguagacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4817 - RNA, 2359 nt, Artificial Sequence
  KY003156.1 prME-long mRNA Design 1 opt
gggagaaagcuuaccaugagaauaauaaaugcgagaaaagaaaaaaaaagaagaggagcugauacaaguguuggaauugugggucucuuauuaacaacagcaauggcagcagaaguaacaagaagagggucagcauacuauauguaucuagauaggaaugaugccggcgaagcuauaucauuuccuacaacauuaggaaugaauaaaugcuauauacaaauaauggaucuuggucauaugugugaugcaaccaugaguuaugaauguccgauguuggacgaaggaguugaaccagaugauguagacugcugguguaauacaacaaguacaugggucguauauggcacaugucaucauaaaaaaggagaagcgagaagaucgcguagagcuguaacacuaccaucacauaguaccagaaaacuacaaacgagaagucaaacauggcuagaaucaagagaauauacaaaacacuuaauacgaguagaaaauuggauauuuagaaacccaggauucgcauuagcagcagcggcaauugcaugguuauuaggaucaaguacgagucaaaaaguaauauauuuaguaaugauacuauuaauagcaccugcauacucaauaagauguauaggaauaaguaaucgagauuucguggaaggaaugucaggagguacauggguagauguaguucuugaacauggaggauguguaacuguaauggcccaagacaagccaacaguagauaucgaauugguaacaacgacaguuaguaauauggcagaaguacgaaguuauuguuacgaagcaucuauuucugauauggcaucagacaguagauguccaacacaaggagaggcuuaucuggacaaacaaagugacacacaauauguauguaaacguacgcuaguugaucgaggauggggaaacggauguggguuauucggaaaagggaguuuaguaacaugugcaaaauuugcauguucgaaaaagaugacgggaaaaagcauacaaccagagaauuuggaauauagaauaaugcuaagugugcacggaucacaacacucagguaugauagucaaugauacuggacaugaaaccgaugaaaaucgugcaaaaguagaaauuacaccaaauaguccaagagcagaagcaacacuaggcggauucgggauauuaggauuagauugugaaccaagaacaggacuagauuuuagcgaucuauacuacuuaaccaugaauaacaaacauugguuaguacauaaagagugguuccaugauaucccucuuccauggcacgcuggugcagauacaggaacaccacauuggaacaacaaagaagcacuaguagaauuuaaagaugcacacgcaaaaagacaaacaguaguaguauuaggaagccaagagggagcaguacauacagcacuagcaggugcauuagaagcagaaauggacggagcgaaagguagauugaguaguggacauuuaaaaugcagauuaaaaauggacaaacuaagacuuaaaggaguaaguuacagucuuuguacagcagcauuuacuuucacaaaaauaccagcugaaacacuucauggaacaguuacuguagaaguucaauaugcagguacagauggaccauguaaaguacccgcacaaauggcaguagauaugcaaacccugacaccaguaggcagacuaauaacagcgaacccaguaauaacagaaagcaccgaaaacucaaaaaugaugcuagaauuagacccaccauuuggagacaguuauauaguuauagguguuggagaaaaaaaaauaacacaucacuggcacagaagugguaguacaauaggcaaagcauuugaagcuacugucagaggcgcaaaaagaauggccguauuaggagauacagcaugggacuuugggagcguuggaggugcauugaauagccucgguaaagggauccaucagauauuuggagcagcauuuaaaagcuuauucggaggaaugucaugguucucacaaauauuaauugguacauuauuaaugugguuagguuugaacacaaagaaugguucaauuucauuaaugugcuuagccuuaggaggaguauuaauauuucuuaguacagcaguaucggcugauguuggauguuccguagauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4818 - RNA, 2359 nt, Artificial Sequence
  KU312313.1 prME-long mRNA Design 1 opt
gggagaaagcuuaccaugagaauaauaaaugcaagaaaagaaaagaaaagaagaggagcagauacaaguguaggaauagugggucuauuauuaacgacugcaauggcagccgaagugacaagacgaggaagcgcauauuauauguaucuagauaggaaugaugcuggagaagcaauuucauuuccaaccacuuuaggaaugaauaaaugcuauauucaaauaauggaucuaggacauacaugugaugcaacaaugaguuaugaauguccaauguuagaugaaggcguagaaccagaugacguagacuguugguguaauacuacaaguacuuggguagucuauggaacaugccaucauaagaaaggagaagcucgacggucacguagagccguaaccuuaccuucucacucaauaagaaaauuacaaacacgaagucaaacauggcuagaaagcagagaauauacaaaacaucuaauacgagucgaaaauuggauauuucgaaauccgggauuugccuuagccgcggcagcaauagcgugguuacucgguaguucaacaucacaaaaaguaauuuacuugguaaugauacugcuuauagccccagccuacucaauaagauguauaggaguaaguaauagagauuuuguugaaggaaugucaggcggaacuugggucgauguaguauuagaacacggcgguugugugacaguuauggcccaagacaaaccaacaguagauauagaauuaguaacaacuacaguauccaauauggcagaaguaagaaguuauuguuaugaagcaucaauaucggauauggcauccgauaguagaugucccacacaaggagaagcauaucuagauaaacaaucagacacacaauauguauguaaacgcaccuuaguagacagagguuggggaaacggauguggauuauuuggaaaaggaagucucgugacuugcgcuaaauuugcauguagcaagaaaaugacaggcaaaaguauacagccagaaaauuuagaauauagaauaauguuaaguguacauggaagucaacauaguggaaugauuguaaaugauacaggacaugaaacagaugaaaacagagcaaaagucgaaauaacaccaaacucaccacgagcagaagccacacuaggaggauuuggaagccuaggcuuagauugugaaccaagaacaggacuagacuuuucagauuuguacuauuuaacuaugaauaauaaacacuggcuaguucauaaagaaugguuccaugacauaccauuaccauggcacgcuggugcagauacagggacaccacacuggaauaauaaagaggcuuugguagaauuuaaagaugcucacgccaaaagacaaacaguaguaguauuaggaucacaagaaggagcuguacauacagcauuagcuggugcguuagaagcagaaauggauggagcaaaaggucgauuaagcucaggacacuuaaaauguagauuaaaaauggacaaauuaagacuaaaagguguaucauauagucuaugcacagcugcauucacauucacaaaaauacccgccgaaacacuucaugguacagucacagucgaaguccaauaugcaggaacugauggaccaugcaaaguaccugcgcaaauggcuguagacaugcaaacgcuaacuccaguaggaagauuaauaacagcaaauccagucauuacugaaucaacugaaaauaguaaaaugaugcuagaauuagauccaccauuuggugauuccuauauaguaauaggcguaggugaaaagaaaauaacucaucauuggcacagaagugggucaacuauaggaaaggcuuucgaagccacaguaagaggugcaaaaagaauggcaguauuaggagacacagcaugggacuuuggaaguguaggaggagcauuaaacagucuagguaaaggaauacaucaaauauuuggagcagcauucaaaucauuauucggcggaaugagcugguuuucacaaauauuaauaggaacccucuuaaugugguuaggacuaaaugcuaaaaauggaucaauuucacuuaugugucucgcacuaggaggaguccuaauauuuuugucgacagcaguaucagcagauguagguuguucuguggacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4819 - RNA, 2359 nt, Artificial Sequence
  KY075935.1 prME-long mRNA Design 1 opt
gggagaaagcuuaccaugagaaucaucaaugcuagaaaagaaaaaaaaagacgcggggcagauacaaguguuggaauuguaggauuguuacuaacaacagcaauggcagcagaaguaacaagacgagggagugcauauuacauguaucuagauaggaaugaugcaggggaagcuauaagcuuuccaacaacucuagguaugaauaaaugcuauauacaaauaauggaccugggucauaugugugaugcaacaaugagcuaugaauguccaauguuagaugaaggaguagaaccagaugacguagacuguuggugcaauacaacaaguacauggguaguauauggaacaugucaucauaaaaaaggagaagcacaacgaagcagaagagcuguaacacuaccaagccacucuacuagaaaauuacaaaccagaucacaaacguggcuggaaucacgugaauauacaaaacaucuuauuagaguagaaaauuggauauucagaaauccgggguuugcauuagcagcagcugcaauagcaugguuacuagguaguucuacuucccaaaaagucauauacuuaguuaugauauuauuaauagcaccagcuuacagcauacgauguauaggcguuaguaauagggauuuuguagaagguaugucaggaggcacauggguagauguaguuuuagaacacggcggaugugucacuguaauggcgcaagacaagccaacaguagacauagagcuuguuacaacaacgguaucaaauauggcagaagugaggucauauuguuacgaggcaucaauaagugauauggcaucagauucaagauguccaacacaaggagaggccuauuuagauaaacaaagcgauacacaauacguaugcaaaagaacacugguugauagaggauggggaaauggauguggacuguuuggaaaaggaaguuuagugacaugcgcgaaauuugccuguuccaaaaaaaugacaggaaaaagcauacaaccagagaauuuagaauauagaauaauguuaagugugcacggaagucaacacaguggaaugauuguaaaugacacaggucacgaaacagaugaaaauagagcuaaaguggaaauaacgccuaauucaccaagggcagaagcaacauuaggaggauucggaaguuuagggcuagacugugaaccaaggacaggguuagauuuuagcgaucuguauuaucugacgaugaacaacaaacauugguuaguacauaaagaaugguuccacgauauaccauuaccguggcaugccggagcagacaccggcacaccacauuggaauaauaaagaagcauuaguagaauuuaaagacgcacaugcaaaacgucaaacaguaguaguucuaggaagucaagaaggugcaguacacacugcauuagccggagcacuagaggcggaaauggacggagcaaaaggucgacuuucaaguggucaucuaaaauguagauuaaaaauggacaaacuucgacuaaaaggaguaucuuauaguuuaugcacagcagcauucacauuuacgaaaauuccagcagaaacauuacauggaacagugacuguagagguacaguacgcgggaacagauggaccauguaaagugccagcacaaauggcaguugacaugcaaacauugacaccaguaggacgacucaucacagcaaaucccguaauaaccgaaucaacggaaaauucaaaaaugauguuggaauuagacccaccauuuggggacaguuauauuguaauaggaguuggagaaaaaaaaauuacucaucacuggcacaggagcggaucaacaauagguaaagcguucgaagcaacuguucgaggagccaaacgaauggcaguauuaggagauacagcaugggauuuugguucaguaggaggagcauuaaacaguuuaggaaaaggaauacaccaaauauuuggagcggcauuuaagucauuguuuggagggaugucaugguucucacaaauacuaauaggaacacuguuaaugugguuaggauuaaauaccaaaaacggcaguauuaguuuaaugugcuuagcacuaggaggaguguuaauauucuuaaguacugcuguaagugccgauguaggcuguagugucgacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4820 - RNA, 2359 nt, Artificial Sequence
  KY014320.1 prME-long mRNA Design 1 opt
gggagaaagcuuaccaugagaauaauaaacgcaagaaaagaaaaaaagagaagaggagcagauaccaguguagguauuguaggucuguuauugacaacagcuauggcagcagaaguaacaagaagaggaagugcuuauuacauguauuuagauagaaaugaugcaggagaagcaauaucauucccaacaacauuaggaaugaauaaaugcuauauacagauaauggacuuaggacacaugugugaugcaacuaugucguaugaauguccaaugcuagaugaaggaguagaaccggaugauguugauugcugguguaauacaacgucaacauggguaguuuauggaaccugucaucauaagaaaggggaagcuagacguucaagaagagcaguaacccuaccaucacacagcacgcgaaaauuacaagcaagaucacagacuugguuagaaucacgagaauauacgaaacacuuaauacgaguagagaauuggauauuuagaaauccaggauuugcauuagcagcagccgcuauagcaugguuacuuggaucaucaacaucccaaaaaguaaucuaccuaguaaugauacuauuaauagcaccagcuuauaguauuagauguauaggaguaaguaauagagauuuuguugaaggaaugagugguggaacguggguagauguaguauuagaacauggcggauguguaaccguuauggcacaagacaaaccaacaguggacauagaacuaguuacaacaacuguaagcaacauggcggaaguaaggucauauuguuacgaagcuagcauaagugacauggcaucagauaguagauguccaacacaaggcgaagccuaucuagauaaacaaucagacacacaauauguauguaagagaacacuuguagaucguggauggggaaacgguuguggauuguuugguaaaggaucacuaguuacuugugcaaaauucgcauguaguaaaaaaaugacgggaaaaagcauacaaccagaaaauuuagaguacagaauaaugcugaguguucaugguucacaacauucaggaaugauaguaaacgauacaggucacgaaacugaugaaaacagagcgaaaguagaaauaacuccaaauaguccuagagccgaagcaacuuuaggcgguuuugguucauuaggauuagacugugaaccaagaacuggauuagauuucucugauuuauacuacuuaacuaugaauaauaaacauuggcuaguccauaaagaaugguuucaugacauaccauuacccuggcacgcaggugccgacacagguacaccacauuggaauaauaaagaagcauuaguugaauuuaaagaugcacaugcaaaaagacaaacaguaguaguauuagggagucaagaaggagcaguacauacagcuuuagcaggggcauuggaagcagaaauggauggcgcuaaagguagacuaucaucuggacacuuaaaaugucgacuaaaaauggauaaauuaagacuuaaaggaguaaguuauagccuaugcacggcagcguuuacauuuacaaaaauaccugcugaaacuuuacauggcacaguuacaguagaaguacaguaugcgggaacagauggucccuguaaaguaccagcucaaauggcuguagauaugcaaacguuaacaccaguaggcagauuaauaacagcaaacccaguuauaacagaaaguaccgaaaauagcaaaaugauguuggaauuagauccaccuuuuggagauucauauauaguaauaggaguuggagaaaaaaaaauaacacaucauuggcauagaaguggaucaaccauaggcaaagcuuuugaggcaacaguaaggggagcaaaacgaauggcaguauuaggagauacagcaugggauuuugguucaguaggaggagcacucaauagucuuggcaaaggcauacaucagauauuuggagccgcuuucaaaucauuauuuggugggaugucaugguucucacaaauucugauaggaacacuguuaaugugguuaggccuuaauacgaaaaauggaucaauuagcuuaaugugcuuagcauuaggaggaguacuaauuuuuuuaucaaccgcaguaagcgcugauguagggugcaguguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4821 - RNA, 2359 nt, Artificial Sequence
  KX827309.1 prME-long mRNA Design 1 opt
gggagaaagcuuaccaugagaauaauaaaugcacgaaaagagaagaaaagacggggcgcagacacaagugucggaauuguaggauuacuucuaacaacagcaauggcagcagaaguaacaagaagaggaagugcauauuauauguaucuggauagaagcgaugcaggagaagcaauuagcuucccaacaacguuagguaugaauaaaugcuacauacaaauaauggauuuaggacauaugugcgacgcaacaaugaguuacgaauguccaaugcuggaugaaggaguagaaccagacgauguggauuguuggugcaacacuacaaguacuugggugguauauggaacuugccaucacaagaaaggugaagcaagaagaucaaggagagcuguuacguuaccaucacacaguacaagaaaauuacaaacaagaagucaaacauggcuggaaaguagagaauacacaaaacacuuaauaagaguugaaaauuggaucuuuaggaacccaggauuugcacuagcugcagcagcaauagccuggcuacuagguaguaguacaagccaaaaaguaauauauuuagucaugauccuauuaauagcaccagcauacucuauaagauguauaggaguaagcaauagagauuucguagaaggaaugucuggaggaaccuggguagauguaguuuuagaacacggaggcugcguaacaguuauggcccaagauaaaccgacaguugauauagaacuuguaacaacaacgguaaguaauauggcagaaguaagauccuacuguuacgaagcaaguauaagugacauggcuucagauucaagauguccaacacaaggggaagcguaccuugauaaacaaucugauacacaauauguuuguaaaagaacccuaguagauagagguuggggaaauggauguggacuuuuuggaaaagggaguuuaguuacaugugcaaaauucgcauguaguaagaaaaugacagguaaaaguauacaaccagaaaauuuggaauacaggauaauguuaaguguccauggaagucaacauagcggaaugauagucaaugauacggggcaugaaacagacgaaaacagagcaaaaguagaaauaacaccuaauuccccgcgagcagaagcaacauuagguggauuuggcucauuaggauuagauugcgaaccaaggacuggauuagauuuuagugauuuguauuauuuaacaaugaacaauaaacauuggcuuguucauaaagaaugguuucaugauauuccacuaccauggcacgcaggagcugauacaggcaccccacauuggaauaauaaagaagcauuggucgaauuuaaagaugcucaugcaaaaagacaaacgguaguaguauuaggaucacaagaaggagcaguacauacagcacuugcuggugcuuuagaagcagaaauggauggagcaaaaggucgauuaaguaguggacauuuaaaauguagauuaaaaauggacaaauugagacuaaaaggugucuccuauagcuuaugcacagcagcauuuacauuuacaaaaaucccagcagaaacauuacauggaacuguaacuguugaaguacaauaugcagguacagauggcccguguaaaguuccagcucagauggcuguugauaugcaaacauuaacaccugucggaagauuaauaacggcaaaucccguaaucacggaaaguacugaaaauaguaaaaugaugcuagaauuagauccaccauuuggggacagcuauauaguaauaggaguaggugaaaagaaaaucacacaucauuggcauaggaguggaagcacaauaggaaaagccuuugaagcaacaguaagaggagcaaaacgaauggccgugcuaggugauacagcaugggauuucggaucaguggguggagcucucaauuccuuaggaaaagggauacaucaaauauuuggagcugcauuuaaaagucuauuuggggguaugucuugguuuagucaaauauuaauuggaacauuacuuauguggcugggauuaaacacuaaaaaugguucgauaaguuuaauguguuuagcauuaggugggguuuuaauuuuucuaaguacagcaguauccgccgauguggguuguaguguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4822 - RNA, 2359 nt, Artificial Sequence
  KU681081.3 prME-long mRNA Design 1 opt
gggagaaagcuuaccaugagaauaauaaaugcaagaaaagaaaagaaaagaagagguacagacaccaguguaggaauaguaggauuacuauugacaacagcaauggcugcagaaguuacacgcagaggaucugcuuacuauauguaccuagauagaagugaugcaggagaagccauuucauucccaacaacuuuagguaugaauaaauguuauauacaaauaauggaucuaggacacaugugcgacgcaacuaugaguuaugaaugcccuaugcuagaugaaggaguagaacccgaugauguugauuguugguguaacacaacaaguacauggguaguauacggaacaugucaucauaagaaaggcgaagcaagaagaagcagacgagcaguuacauuaccgagccauucaacaagaaaacuacaaacaagaucucaaaccugguuagaaagucgagaauauacaaaacauuuaauuagaguagaaaacuggauauucagaaauccaggauuugcuuuagcagcugcagcuauagcauggcuacuaggaucauccacaucacaaaaaguuauauacuuaguaaugauucuauuaauagccccagcauauucaauaagaugcauagguguaaguaauagagauuucgucgaaggaaugaguggaggaacauggguugacguaguacuagaacauggaggcuguguaacaguaauggcccaagauaaaccgacuguagauauagaauuaguaacaacaacaguaaguaauauggccgaagucagaucauacuguuaugaagccagcauaagugauauggcaagcgauuccagauguccaacucaaggugaggcauauuuagauaaacaaucggauacacaauaugugugcaaaagaacucuaguagacagaggauggggaaacggcuguggauuauuuggaaaaggaagucuaguaacaugugccaaauuugcaugcucaaagaaaaugacuggaaaaucaauacaaccagaaaaucuagaauaucgaauaauguuaagugugcauggaagucaacacagcggaaugauaguaaacgauacuggucaugagacagacgaaaacagagcaaaaguagaaauaacaccuaauucaccacgagcagaagcaaccuuaggaggcuucggaucccuaggauuagauugugaaccacgaacaggcuuagacuuuagugauuuauauuauuuaacaaugaauaacaaacauuggcugguacauaaagaaugguuucacgauaucccauuaccauggcacacaggugcagauacaggaacaccacauuggaacaacaaagaggcgcuuguagaauuuaaagaugcucacgcaaaaagacaaacaguuguaguauugggaucucaagaaggcgcaguacauacagcauuagcuggagcucuagaagcagaaauggacggugcaaaaggccgacugucuucuggucacuuaaaaugcagacucaaaauggauaaauuaagacuuaaaggcguaucauacaguuuauguaccgcugcuuucacauuuacaaaaauaccagcugaaacuuuacauggaaccguaacaguagaagugcaauacgcugguacugauggaccauguaaagugcccgcucaaauggcaguagauaugcagacacuaacaccagugggacgauuaauuacugcaaauccaguuauuacagaaggaacagaaaacucaaaaaugauguuagaauuagauccaccauuuggugauucauauauaguaauaggaguaggugagaaaaagauuacacaucauuggcauagaucaggaucaacaauagggaaagcguucgaagcuacaguaagaggagcuaaaagaauggcaguauuaggagacacggcaugggauuuuggaucaguggguggaguacucaauucauugggaaaaggaauacaccaaauauucggagcagccuucaaaagccuauuuggaggaaugaguugguuuagucaaauacucauaggaacauuguuaauguggcuaggcuuaaauacuaaaaauggcaguauaucacuaaugugucuugcacugggaggaguacuuauauuucuaucaacagcuguauccgcagauguaggauguagcguagauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4823 - RNA, 2359 nt, Artificial Sequence
  KU744693.1 prME-long mRNA Design 1 opt
gggagaaagcuuaccaugagaauuauaaaugcaaggaaagaaaaaaaaagaaggggagcugauacaucaguaggaauaguuggucuucuacuaacuacagcaauggcagcggaaguaacgcgaagaggaucagcauauuauauguaucuagauagaaaugaugcaggagaggcaaucucuuuuccuacaacauuaggaaugaacaaauguuacauacaaauaauggacuugggacauaugugcgaugcaaccaugucauaugaauguccuauguuggaugaagguguagaaccugaugacguugauuguuggugcaauacaacaucaacauggguaguauacgggacaugucaucacaaaaaaggugaagcuagaagaucaagaagagcuguuacauuaccuucacacucaacacgaaaauuacaaacaagaucacaaacaugguuagaaucaagagaauauacaaaacaccuaauaagaguagaaaauuggauauuuagaaauccagguuuugcauuagcagcagcagcaauagcaugguuauuaggauccucaacgagucaaaaaguuauuuauuuaguaaugauuuuguuaauugcuccagcuuauucaauaagaugcauagguguaaguaaucgagacuuuguagaagggaugaguggugggacauggguagauguaguauuagaacacggcggaugcguaacggcaauggcgcaagacaaaccaacaguagauauagaacuaguuacaacuacgguuucuaacauggcagaaguaagaucuuauugcuacgaagcaucaauaucagacauggcaucugauaguagauguccaacacaaggggaagcauaucuagauaaacaaucagauacacaauauguauguaaacgaacucuaguagaccguggcugggguaacggaugcgggcucuuuggaaaaggaucauuaguaacaugugcaaaauuugcuuguuccaagaaaaugacaggaaaaagcauacaaccagaaaaccuugaauauaggauaauguuaucaguacauggcucacaacauagugguaugcuuguaaaugauacaggacaugaaacggacgaaaaccgagcaaaaguugaaauaacuccaaauaguccgcgagcugaagcaacguuaggcggauuuggaagcuuagggcuagauugugaaccaagaacaggauuggauuucucagaucuuuauuauuuaacaaugaauaauaaacauugguuagcacacaaggaaugguuccaugauauaccccuaccauggcaugcaggugcagccacgggaacuccucauuggaacaauaaagaagcauuaguagaauuuaaagacgcacacgccaaaagacaaaccgucguuguacuuggaucacaagagggagcaguacauacagcauuagcaggagcauuggaagcagaaauggauggugcuaaaggaagauuaucuagcggacaucuaaaaugcaggcuaaaaauggacaaacuacgauuaaaagguguaagcuauagucuaugcacagcagcuuuuacauuuacaaaaauacccgcagagacuguugacgguacaguaacaguagaaggucaauauggagggacugaugguccuugcaaaguuccagcacaaauggcagucgacaugcaaacacuaacgccaguugguagacuaauaacagcgaaucccgucauuacagaaucaacagaaaauucuaaaaugauguuagaauuagauccaccauuuggcgauagcuauauaguuaucggaguaggcgaaaaaaaaauaacucaucauuggcaccggaguggaagcacuauaggaaaagcauucgaagccacaguaaggggugcaaaaagaauggcagugcuaggagauacugcaugggauuuuggaaguguagggggcgcauuaaauaguuuaggaaaaggaauacaucaaauaauaggugcagccuuuaaaagucuauucggaggaaugaguugguuuagccaaauauuaauaggaaccuuacugaugugguuaggacuuaacacgaaaaauggaagcauaucacuuaugugucucgccuugggaggaguauuaauauuucuaucgacggcaguaagcggcgggguagguuguucaguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4824 - RNA, 2359 nt, Artificial Sequence
  KY328290.1 prME-long mRNA Design 1 opt
gggagaaagcuuaccaugagaauaauaaacgcaagaaaagaaaaaaaaaggagagguacagauacauccgucggaauaguggguuuauuacuuacaacugcaauggcggcagaaguaacacgaagaggaagcgcauauuauauguauuuagaucgaagugaugcgggagaagcaauaagcuucccaacaacauuaggaaugaacaaauguuauauacaaauaauggauuuaggacacaugugugaugcaacgaugucauaugaauguccaauguuagaugaaggaguagaaccggaugaugucgauuguugguguaauacaacaucaacauggguaguauauggaaccugccaucauaaaaaaggugaagcaagaagaucuaggagagcaguaacgcuuccaagucauaguacaaggaaauuacaaacuagaagucaaacaugguuagaaaguagagaauacacuaaacauuuaauacgaguagaaaacuggauauuuagaaauccaggcuucgcauuagccgcagcugccauagcaugguuauuagguucgaguacgucacaaaaaguuauauauuuaguuaugauucuauuaauugcccccgcauauaguauaagaugcauaggagugaguaaccgggauuuuguugaaggaaugucaggaggaacaugggucgauguuguauuagaacaugguggaugcguaacaguuauggcacaagacaaaccaacaguggacauagaauuaguaacaacaacgguaaguaauauggcagaaguacgaaguuacuguuaugaagcaaguauaucagauauggcaagcgauucuagauguccaacucaaggcgaagcauaucuagauaaacaauccgauacacaauacgugugcaagaggacguugguagauagaggaugggguaaugggugcggguuauucggaaaagguucauuaguaaccugcgcuaaauucgcguguucuaaaaaaaugacaggaaaaucaauacaaccggaaaauuuagaguauagaauaauguugucaguucauggaagucaacauucaggaaugauaguaaaugauacuggacaugaaacagacgagaaccgagcaaaaguugaaauaacaccaaauaguccaagggcagaagcuacauuaggaggauuuggcucucuaggacuggauugugaaccaagaacuggcuuagauuuuagcgaccuauauuaccuaacgaugaauaauaagcacuggcuaguacacaaagaaugguuccacgauauaccauuaccauggcaugcaggugcagauacaggaacuccacauuggaauaauaaagaagcacuaguggaguuuaaagacgcacaugcaaaaaggcaaacaguuguaguuuuaggcagucaagaaggcgcuguacauacagcauuagcaggagcacuagaagcggaaauggauggagcaaaaggaagauuaucaagcggacaucuaaaauguagguuaaaaauggauaagcuuagauuaaaaggagucaguuacucauuauguacggcagcuuuuaccuuuagcaaaauaccagcagaaacacuacacggcacaguuacugaagaagugcaauaugcuggaacugauggcccaugcaaaguaccggcacaaauggcaguagauaugcaaacacuaacaccaguaggaagauuaauaacagcaaacccaguaauaacagaaucaacagaaaacaguaaaaugauguuagaauuagacccaccauuuggagauucauauauagucauaggaguaggagaaaaaaaaauuacccaucauuggcauagaagugguaguacaauaggcaaagcauucgaagcuacaguaagaggagcaaaaaggauggcagucuuaggagacacagcaugggauuuuggaucaguaggaggagcuuuaaauaguuuaggaaaaggaauucaucagauauucggagcagcauuuaaaagccuauucgguggaaugagcugguuuucgcaaauauugauaggaacauuacuaaugugguuaggauuaaacacaaaaaacggaucuauaagucugaugugccuagcguuagggggcguucuaauauuccucucaacagcaguaucagcggacguaggauguucaguagauuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4825 - RNA, 2359 nt, Artificial Sequence
  KX694532.2 prME-long mRNA Design 1 opt
gggagaaagcuuaccaugagaauaauaaaugcacgaaaagaaaaaaaaagaagaggaacagacacuucaguaggcauuguaggacuacuacuuacaacagcaauggcagcagagguaacacgaaggggaagugcauauuauauguauuuagacagaucagaugcaggagaagcgaucucauuuccuacaacauugggaaugaauaaauguuacauccaaauaauggaucugggccauaugugugaugcaacaaugaguuacgaauguccaauguuagaugaaggggucgagccagaugauguagauuguugguguaauaccacuucaacauggguuguuuauggaacaugccaucauaaaaaaggagaagcaagaagauccagaagggcaguaacauuaccaucacauucuacacgaaaauuacaaacccgaucgcaaacauggcuagaaaguagagaauacaccaaacauuuaauaagagucgaaaauuggauauucagaaacccaggcuuugcuuuagcagcagcugcgauagccuggcuacuaggaaguagcacuucacaaaaagucaucuauuuaguaaugauuuuacuaaucgcuccagcauacagcauuagauguauuggaguuaguaauagagacuuuguagaaggaaugucaggcggaacauggguugaugugguccuagaacauggcggauguguaacaguaauggcccaagauaaacccacaguagauauagaauuaguaacgacaacagugagcaauauggcagaaguaagaucauauugcuacgaagcuucaauaucugauauggcaagcgauucgagaugcccaacacaaggagaagcauaucucgauaaacaaagcgacacucaauauguaugcaaaagaacacuaguagacagaggcugggguaaugguugugguuuguuuggaaaagggaguuuaguaacaugugcuaaauucgcaugcucgaagaaaaugacaggcaaaucaauacaaccugaaaauuuagaauacagaauaaugcuaaguguacaugguucacaacauucagguaugauuguaaaugauacaggucacgaaacagaugaaaauagagcuaaaguagaaauaacccccaauucaccaagagcugaagccacacuaggaggcuucgguaguuuaggguuagauugugaaccuagaacagggcuugauuuuucagaccuuuauuaucucacaaugaauaauaaacacuggcucguacauaaagaaugguuccaugacauaccucuacccuggcacgcuggagcagauacaggaacgccacacuggaauaauaaagaagcuuuaguagaauucaaagaugcccacgccaaaagacaaacuguaguaguacuaggaagucaagaaggagcaguacacacagcuuuagcaggagcauuagaagcggaaauggacggagcgaaaggaagauuaucaucuggucauuuaaaauguagauugaaaauggauaaacuaagauuaaaagguguuucauauagcuuaugcacagcugcauuuacauuuacaaaaauaccagcagaaacuuuacauggcacaguaacaguagaaguccaguaugcagguacugauggaccuuguaagguacccgcacaaauggcaguagauaugcaaacacucacaccaguaggaagacuaauuacagcuaauccaguuauuacagaaagcacagaaaauuccaaaaugaugcuagaguuagauccaccuuuuggugacaguuauauagugauaggggucggagaaaaaaaaauaacacaucacuggcauagaagcggaucaacaauaggaaaagcauuugaagccacaguaagaggagcuaaaagaauggcuguacuaggcgauacagcaugggauuucggaaguguuggcggagcucugaacagccucgggaaagguauacaucaaauauuuggugcggcauuuaaaaguuuauuuggaggaaugucaugguuuucacaaauauuaauaggaacacuacuaaugugguuaggucucaauacuaaaaauggaaguauaagcuuaauguguuuagcauugggaggagucuuaauauuccuaucaacagcaguaagugcagauguaggauguaguguugauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4826 - RNA, 2359 nt, Artificial Sequence
  KU955593.1 prME-long mRNA Design 1 opt
gggagaaagcuuaccaugagaaucauuaaugcacguaaagaaaagaaaagaaggggaacagauacgucuguaggaauaguuggacuacuauuaacaacugcaauggcuguagaaguaacaagaagaggaaaugccuauuauauguauuuagauaggucggacgcaggagaagcaauuucauucccaacaacaaugggaaugaacaaauguuauauccaaaucauggaccuuggacauaugugugacgcaacaaugucauaugaauguccaauguuagaugaagggguugaaccagaugauguagauuguuggugcaacacaacaagcacauggguagucuacggaacaugucaucauaagaaaggagaagcacgaagaucaagacgagcaguuacauuaccaagucacucaacaagaaaauuacaaacaagaucacaaacauggcucgaaaguagagaauacaccaaacaucugauccgaguagaaaacuggauauuuagaaaucccgguuuugcucuugcugccgccgcaaucgcaugguuacuaggaucgucuacuucacaaaaaguuauauauuuaguaaugauauuauugauagcuccagcauauuccauuagaugcauaggaguuuccaauagagauuuuguagaagggaugagcggagguaccuggguagauguaguauuagaacacggaggaugcguuacaguaauggcacaagacaaaccaacaguagacauagaauuaguuacaacaacaguaucaaacauggcagaaguucguuccuauugcuacgaagcaaguauuucagauauggcaagugauaguagauguccgacacaaggagaagcauauuuagacaaacaaucagacacucaauauguauguaaaagaacucuaguagauagagguuggggaaauggcuguggauuauucggcaaaggaucucuaguaacaugugcaaaauuugccuguaguaagaaaaugacaggaaaauccauccaaccagaaaauuuagaauaucgaauaauguuaucaguacauggaucacaacauuccggaaugaucgucaacgauacuggucaugagacugaugaaaauagagcaaaaguagaaauaacaccaaauucaccucgagcugaagcaacauugggaggauuuggaucacuaggacuagacugugaaccaagaacaggacuugauuuuagcgacuuauauuaccuuacgaugaacaauaaacauugguuaguacauaaagaaugguuucacgacauaccacuaccuuggcaugcaggagcagauacgggaacuccccauuggaacaauaaagaggcuuuaguagaguucaaagacgcacacgcaaaaagacaaacaguaguaguucuuggaagucaagaaggagcuguacacacagccuuagcuggugcacuagaagcagaaauggauggagcaaaaggaagauuaaguaguggacacuuaaaauguagauuaaaaauggauaaauuacgauuaaaaggaguuucauauucauuaugcacagcagcuuuuacguucacgaagauaccagcagaaacacugcacggaacaguaacaguagaaguacaauaugccgguacagauggaccuuguaagguaccagcacaaauggcuguugacaugcaaacauuaacucccguugguagacuaauaacagcaaauccaguaauaacugaaagcacagaaaauucuaaaaugaugcuagaauuagauccaccuuuuggagauagcuacaucguaauaggaguuggcgaaaagaaaauaacucaucacuggcaccguucagggucaaccauugguaaagcauuugaagcaacaguaagaggagccaaaagaauggcgguacuaggagauacggcaugggauuuuggaaguguaggaggugcccuaaauuccuuggguaaaggaauacaccaaaucuuuggagccgcauuuaaaucauuauucgggggaaugaguugguucagccaaauauuaauuggaacacuauuaguaugguuaggauugaauacuaaaaauggaucuauaucacuaaugugccuagcauuaggaggagugcucauauuccuaaguacugcuguuucagcagauguaggauguaguguagauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4827 - RNA, 2359 nt, Artificial Sequence
  KY272987.1 prME-long mRNA Design 1 opt
gggagaaagcuuaccaugagaauaauaaaugcaagaaaagaaaaaaaacgaagaggaacagauacaagcguggguauaguuggcuugcuauugacuacugcaauggcagcugaaguaaccagaagaggaagugcauacuacauguaucuagaucguucugaugccggugaagcaaucucauuuccuacaacauuagguaugaacaaauguuauauacaaauaauggaucuaggucauaugugugaugcaacaaugucuuaugaauguccuaugcuggacgagggaguugaaccagaugacgucgauugcuggugcaauaccacguccacauggguaguuuauggaacuugucaccacaaaaaaggagaagcaagaagaaguagaagagcaguaacgcuaccaagucauaguacaagaaaacuccaaacaaggucacagacuuggcucgaaaguagggaauauacuaaacaucuaauacgaguagaaaauuggauauuuagaaauccaggguuugcguuagcagcagcagcaauagcuugguuauuaggcuccaguacuucacaaaaaguaaucuacuuaguaaugauauuauuaauagccccagcauauucaauaagauguauagguguuaguaauagagauuuuguagaaggaaugucaggagguacuuggguagaugucguucuagaacacggaggaugcguaacaguaauggcacaagauaaacccacuguagauauagaacuaguuacaacaacuguauccaauauggcagaaguaagaaguuauuguuacgaagcuagcauaagcgauauggcaagugacucaagaugucccacacaaggugaagcauaccuugauaaacaaucagauacucaauauguaugcaaacguacacugguagaccguggaugggggaauggaugcggacuauucgguaaaggauccuuaguuacaugugcaaaauuugcuuguucaaaaaaaaugacugggaaaucaauacaaccagaaaacuuagaauauagaauuauguuaucgguacacggaucacagcauucuggaaugauaguaaaugauacaggacaugaaacagaugaaaaucgagcuaaaguagaaauaacuccuaauaguccaagagcggaagcaacucuaggagguuuuggaagucuaggauuagauugcgaaccgagaacuggguuagacuuuucagauuuauauuaucuaacuaugaacaacaagcacugguuaguacauaaagagugguuucaugauauaccgcuaccauggcaugcgggagcugauacaggaacuccacauuggaauaauaaagaagcacuaguggaauuuaaagaugcacaugcaaaacgacaaaccgugguaguacuaggaucacaagaaggagcaguacauacagccuuagcuggugcauuagaagcagaaauggauggagcaaaaggaagauuaaguaguggucaucuaaaauguagacuaaagauggacaaauuaagauuaaagggagugucuuacagucuauguacagcagccuuuacauuuacaaaaauaccugcugaaacauuacacggaacaguaacuguggaaguacaauaugcagguaccgauggaccauguaaaguuccugcacaaauggcuguagauaugcaaacucucacaccgguaggacgacuaauaacagcaaauccaguaaucacagaaaguacugaaaauaguaaaaugaugcucgaguuagauccacccuuuggcgacagcuauauaguaaucggaguaggugaaaaaaaaauuacacaccacuggcacaggaguggaagcacaauaggaaaagcuuucgaagcaacaguuagaggugcaaaaagaauggcuguacugggagauacagcaugggacuuuggaaguguaggaggagcacuaaauagcuuaggaaaaggaauacaccaaauauuuggagcagcauuuaaaucacuauuuggagguaugaguugguuuucgcaaauuuuaauaggaacauuauuaaugugguuagggcuaaauacaaaaaauggaaguauaucauuaguuugucuagcgcucggaggaguacuuauauuuuuaagcacagcaguaucagcagacguuggauguaguguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4828 - RNA, 2359 nt, Artificial Sequence
  EU545988.1 prME-long mRNA Design 1 opt
gggagaaagcuuaccaugagaauaauaaaugcaagaaaagaaaaaaaaagaagaggaacagacacaaguguuggaauuguugguuuacuacuuacgacagcuauggcaguagagguuacaaggagagguagugcauauuauauguaccuagauagaucagaugcaggagaagccauaucauuuccgaccacuuuaggaaugaauaaauguuauauacaaauaauggaucuaggacauaugugugaugcaacaaugaguuacgaaugcccaauguuagaugaaggaguagaaccugaugauguagauugcugguguaacacuaccucaacauggguuguauacggaacaugucaucauaaaaaaggugaagcuagacgaagcagacgagcuguaacguuaccaagucauucaacacgaaaacuacaaacuagaucacagacauggcuugaaucaagagaauauacaaaacacuuaauuagaguugaaaauuggauauuuagaaauccaggauuugcacucgcagcagcagcaauugcauggcuccuuggcaguaguacaucacaaaaaguaauauauuuaguuaugauauuauuaauagcuccagcauacaguauucgaugcauaggaguuucaaacagagacuuuguagaaggaaugucaggaggcacauggguagacguaguacuagaacacggcggauguguuacaguuauggcccaagauaaaccagccguagauauugaauuaguuacuacgacaguaaguaauauggcagaagugagaucauauuguuaugaagcaaguauaucagauauggcgucagauagccguugccccacccaaggcgaagcuuaucuagacaaacaaagugacacacaguacguauguaaaagaacauuaguagacaggggauggggaaauggaugcggacuauuuggcaaaggaagcuuaguaacaugcgcaaaauucgcuuguagcaaaaaaaugacaggaaaaucaauacaaccagaaaacuuagaauauagaauuauguugucaguacacgggagucaacauuccggaaugauaguaaaugacacuggucacgaaacagacgaaaauagagcaaaaguagaaauaacgccaaauucuccuagagcagaagcaacacuaggaggauuugggucuuuaggguuagacugugagccaagaacaggauuagauuuuucugauuuauauuauuuaacaaugaauaacaaacauugguuaguacauaaagagugguuccaugacauaccucuaccauggcaugcaggagcagauacuggaacuccacacuggaauaacaaagaagcacuuguugaauuuaaagacgcucaugcaaaaagacaaaccguaguuguauuaggaucacaagaaggugcggugcacacagcuuuagcaggggcccuagaagccgagauggauggugcaaaagguagacuuagcucuggucaccuuaaaugccgacuaaaaauggauaaauuaagacuaaagggaguaaguuauagccuauguaccgcagcguuuacauuuacaaaaauaccagcagaaacacuacauggaaccgugacaguagaaguucaauacgcaggaacagaugguccauguaaaguaccagcacaaauggcaguagauaugcaaacauuaacaccagugggaagauuaauaacagcaaacccaguaauaacagaaaguacagaaaauucaaaaaugauguuagaauuagaccccccuuuuggagauagcuauauagucauagguguuggcgaaaaaaaaauaacacaucauuggcauagaagcgguucaacaauaggaaaggcauuugaagcaacgguacgaggugcgaaaaggauggcuguauuaggagauacggcaugggauuuuggaucaguaggaggagcguuaaauucauuaggcaaaggaauacaucaaauauucggagcugcguuuaaaucauuauuuggugguaugucaugguucagucaaauauuaauaggaacacuuuuagucuggcuagguuuaaacaccaaaaaugguagcauaucauuaacaugcuuagcauuaggaggaguauuaauauuccucagcacagcgguuucagcagacguaggauguaguguagauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4829 - RNA, 2359 nt, Artificial Sequence
  KU681082.3 prME-long mRNA Design 1 opt
gggagaaagcuuaccaugagaauaauaaaugccagaaaagaaaaaaaaagaagaggagcggacacuucaguagguauaguaggacuauuauuaacaacagcgauggccguagaaguaacaagaagaggaagugcauauuauauguacuuagauagaagcgacgcaggagaagcgaucaguuucccaacaacauuagguaugaauaaauguuauauacaaauaauggaucuuggacauaugugugacgcaacuaugucauacgaauguccaaugcuagacgaaggaguagaaccugaugacgucgauuguugguguaauacaacuagcacauggguaguauauggaacaugucaucauaaaaagggugaagcuagaagaaguagaagagcaguaacgcuuccaucacacaguacaagaaaauuacaaacuagaagucaaacauggcuagaaucuagagaauauacuaaacaucucauacgaguagaaaacuggauauuucguaauccgggauuugcauuggcugcggcuguaauagccugguuauuaggaaguaguacaagucaaaaagugauauauuuaguaaugauacuacuuauugcuccagcuuacaguauaagaugcaucggaguaucaaauagagauuucgucgaaggaaugaguggagggacauggguagacguaguacuagaacauggaggcugcguaaccguaauggcacaagauaaaccaacaguagauauagaauuaguaacaacgacaguuuccaauauggcugaaguacgaucauacuguuaugaagccagcauuagugacauggcaucugauucuaggugucccacucaaggugaggcauaucuagacaaacaaucagauacacaauauguauguaaaagaacauuaguagauagaggaugggggaauggaugugggcuauuuggaaaaggaucguuagucacaugcgcgaaauuugcuuguucaaaaaaaaugacaggcaaaucaauucaaccugagaauuuagaauauagaaucauguuaucaguucauggaucacaacacagcggaaugauaguaaaugauacgggacaugaaacugacgaaaauagagcaaaaguugaaauaacuccaaauuccccuagagcagaagcaacacuagguggauuuggaucauuaggacuagauugcgaaccaagaacaggauuagauuuuagcgaucuauacuauuuaacaaugaauaacaaacauugguuaguacauaaagaaugguuucaugauauaccauuaccauggcaugcaggggcagacacugguacaccgcauuggaauaauaaagaagccuuaguagaauuuaaagacgcacaugcaaaaagacaaacaguugucguauuagguucucaagaaggagcaguacauacggcuuuagcaggagcucucgaagcugagauggacggagcaaaaggcagacuuucaaguggacaucucaaauguagguuaaagauggauaaacuucgauuaaaaggaguaaguuacucccuauguacugcagcauuuacuuuuacaaaaauaccagcugaaacuuugcauggaacaguaacaguagaaguacaauacgcaggaacggacggaccaugcaaaguuccagcacaaauggcaguagauaugcaaacacugacgccaguaggaagguuaauuacagcgaacccaguaauuacagaaucuaccgaaaauucaaaaaugauguuagaauuagaccccccuuuuggagacucuuacauaguuaucggaguaggugaaaaaaaaauaacacaccauuggcaucguagugguuccacaauaggaaaagcuuucgaagcaacuguaaggggagcaaaaagaauggcaguuuuaggagacacggcaugggacuucggaaguguaggaggggcacugaauucucuaggaaaaggcauacaucaaauauuuggugccgcauuuaaaucauuauuuggaggcaugaguugguuuucucaaauauuaauugguacauuauuaguauggcuaggauugaauaccaaaaacggauccauaucacuaacaugucuagcacuuggaggaguucuaaucuuucuaucaacagcuguaucagcagauguaggcuguucuguagauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4830 - RNA, 2359 nt, Artificial Sequence
  KX601167.1 prME-long mRNA Design 1 opt
gggagaaagcuuaccaugagaauuauuaaugcaagaaaagagaaaaaaagaagaggagcagauacaaguguuggaauaguaggauuacuacuaacaacagcaauggcaguggaaguaacacgcagaggaucugcauauuauauguaucuagauagaagugaugcuggagaagcaauaaguuuuccgacaacucuaggaguaaacaaauguuauauucaaauaauggaucuaggacacaugugcgaugcaacuaugucauacgaguguccuauguuagaugaaggugucgaaccugaugauguagacuguugguguaauacaacauccacguggguagucuauggcacaugucaucauaaaaaaggagaagcuagacgaucaagaagagcaguuacucuaccaagccacucgacaagaaaacuacaaacaagaucacaaacauggcuugaaucaagagaauauacaaaacaucuaauaagagucgaaaauuggauauucagaaauccaggauuugcauuagcagccgcagcaauagcaugguuauuaggcucaaguacaagccaaaaaguaauauaucuaguaaugauacucuuaauagcaccagcauacucuauaagaugcauugguguuaguaacagagacuuugucgaaggaaugucgggaggaacuuggguagauguaguacuagaacaugguggauguguaacaguaauggcacaagauaaaccaacaguagauauagaauuaguuacaacaacgguaucaaauauggcagaaguuagaagcuacuguuaugaagcaaguauuucagacauggcaucagacucaagauguccuacacaaggagaagcauaucuugauaaacaaagcgauacacaguacguauguaaaagaacacuaguugauagaggaugggguaauggauguggucuauuuggaaaaggaaguuuaguaacuugugcaaaauuugcauguucuaaaaaaaugacaggaaaaucaauucaaccugaaaacuuagaauauagaauaauguuaucuguacauggaucccaacauucaggaaugauuguaaaugauacaggucaugaaacagaugaaaauagagcuaaaguagaaaucacuccgaacucaccacgagcagaagcuacuuuaggaggauucgggucauuaggccuugauugcgaaccaaggaccggacuagauuuuucagauuuauacuacuuaacuaugaauaauaaacacugguuaguacacaaggaaugguuucaugacauacccuuaccauggcaugcaggagccgacacaggaacuccacauuggaauaauaaagaagcacuaguagaauucaaagaugcucaugccaaaagacaaacaguaguaguuuuaggaagccaagaaggcgcuguccauacagccuuagcaggagcacucgaagcagaaauggauggagccaaaggaagacuaucaucaggucauuuaaaaugucgucuuaaaauggauaaauuaagacuuaaagguguuaguuauagcuuauguacagcggcauuuaccuuuacaaaaauaccugccgaaacacuucacggaacaguuacaguugaaguacaauaugcagggacagacggaccaugcaaaguuccugcacaaauggcaguugauaugcaaacauuaacaccaguaggcagauuaauaacagcaaacccaguuauaacugaaucaaccgaaaacaguaaaaugauguuagaauuagauccaccuuuuggcgacaguuauauaguaauaggaguaggugacaaaaaaauaacucaucacugguacagaaguggaucaacuauagggaaagcauuugaagcaacaguaagaggggcaaaaagaauggccguauugggagauacggcaugggacuuuggcucaguaggcggugcuuugaauaguuuaggaaaagguauacaucaaauauuuggagcagcauuuaaaucauuguuuggaggaaugaguugguuuucucaaauuuugauugguacauuauuagugugguuaggacuaaauaccaaaaacggaaguaucagccuaacuugcuuagcccuaggggggguacuaauauuuuuaaguacagcagugagugcggacguaggaugcagugucgacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4831 - RNA, 2359 nt, Artificial Sequence
  KX694533.2 prME-long mRNA Design 1 opt
gggagaaagcuuaccaugaggauaaucaaugcaagaaaagaaaaaaaaagaagaggugcugacacauccgucggaauaguaggacuguuacuaaccaccgcgauggcuguagaaguaacacgacgcggcagcgcauauuauauguacuuagauagaagugaugcagguaaagcaaucuccuuuccaacaacauuaggaguaaauaaauguuacauacaaauaauggauuuaggacauaugugugaugcaacaaugucauaugaauguccuaugcuggaugaaggaguagaaccugaugacguugauuguuggugcaauaccacuucaacaugggucguauauggaacaugucaucauaaaaaaggagaagcuagaagaagcagaagagcgguuacucuuccaagucauaguacuagaaaacuacaaacaagaucucaaacuuggcuugaaucaagggaauacaccaaacauuuaauaagaguagaaaauuggaucuucagaaauccaggauucgcacuagcagcagcggcaauagcauggcuacuugguucaucuacaagccaaaaaguaauauauuuagucaugauacuauuaauagcacccgcauauucuaucagaugcauaggaguaaguaauagagauuuuguagagggaauguccggaggaacauggguagauguaguccucgaacaugguggauguguuacagugauggcacaagacaagccaacaguagauauagaauuaguuacgacaacugucucaaauauggcagaaguaagaagcuauuguuaugaagcaagcauaucugauauggcaagcgauucaagauguccuacucaaggagaagcguauuuagauaaacagucagacacacaguacguauguaaacgaacacuaguagacagaggauggggaaacggauguggauuauucggaaaagguaguuuaguaaccugugcaaaauuugcguguucaaaaaaaaugacuggaaaaaguauacaaccagaaaauuuagaauauaggauaaugcucagcgugcauggaucacaacauucaggaaugauaguaaacgauauaggacaugaaacagacgaaaaucgagcaaaagucgagauaacacccaauucaccacgagcagaggcuacccuuggagguuucggaucauuaggauuggauugcgaaccacgaacaggacucgauuuuagugauuuauauuaucuuacaaugaacaacaaacauugguuaguacauaaagaaugguuucaugacauuccacuaccauggcaugcaggagcagauacugguacaccacacuggaacaauaaagaagcacuaguagaauuuaaagaugcucacgcuaaaagacaaacaguagugguauuaggaagucaagaaggagcaguacauacagcacuagcaggagcccuggaagccgaaauggauggagcaaaaggaaggcuaucaucaggccaucuaaaaugcagacuaaaaauggauaaauugagauuaaaaggaguaucguauagcuuaugcacagcagcguuuacuuuuacaaaaauaccagcugaaacacuacacggaaccguaacuguagagguacaauacgcaggaacagaugguccauguaaagucccagcacaaauggcaguagauaugcaaacauuaacacccguaggaaggcuuauaacugcaaauccaguuauaacagaaaguacagaaaauucuaaaaugaugcuggaauuagauccacccuucggagauucauacauaguaauaggaguaggagauaaaaaaauuacacaucauuggcauagaucugggaguacaauugguaaagccuuugaagcaacagugcgaggcgcaaaaagaauggcaguauuaggagauacagcuugggauuuuggaucagugggaggagcauuaaauaguuuaggaaaaggaauacaucaaauauucggagcagcauuuaaaagucuauuuggaggcaugucaugguuuucacaaauucuuauaggaacgcuuuuaguaugguuaggauuaaauacaaaaaauggaucaauaucacugacauguuuagcgcuagguggcguuuuaauauuuuuaagcacggcaguaucagcagacguaggaugcucaguagauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4832 - RNA, 2359 nt, Artificial Sequence
  KY288905.1 prME-long mRNA Design 1 opt
gggagaaagcuuaccaugagaauaauaaaugcaagaaaagaaagaaaaagaagaggagcagauacaagcauagguauaguagggcuauuauuaacaacugcuauggcagcagaaaucacgagaagaggaagugcauauuacauguauuuggacagaucugaugcaggaaaagcaauaucuuucgcaacaacuuuaggcguaaacaaaugucauguucaaauaauggacuuaggccacaugugugaugcgacaaugaguuaugaauguccaauguuagaugaaggaguagagccagaugauguugauuguuggugcaauacaacaagcacaugggucguuuacgggacuugucaucauaagaaaggagaagcaagaagaaguagacgagcuguuacuuuaccaagccauaguacaagaaaauugcagacaagaagccaaacauggcucgaaagcagagaauauacaaaacauuuaauaaaaguagaaaauuggauauuccgaaacccaggauuuacgcugguagcaguagccauagcuugguuguuaggauccuccacgucacaaaaagugauauacuuagugaugauauuacuaauugcaccagcuuauucaauaagguguauaggaguaucaaauagagauuuuguagaaggaaugaguggaggaacuuggguagacguaguacuagaacauggagguugugugacuguaauggcacaagauaaaccgacuguugauauagaacuuguaacaacaacuguaucaaauauggcugaaguaagaucauacugcuaugaagcaucuauaagugauauggccuccgauucaaggugcccaacacaaggggaggcuuacuuagauaaacaaagugauacacaauauguauguaaacgaacauuaguagauagaggaugggguaaugguugcggauuauuuggaaaaggaaguuugguaacaugugcuaaauuuacuugcaguaagaaaaugacaggcaaaagcauacaaccggaaaaucuggaauauagaauaauguuaucaguacauggaucacaacauaguggaaugauaguaaaugacacugggcaugaaacagaugaaaauagagcaaaaguagaaguuacaccgaacagcccaagagcggaagcaacuuuagguggguucggaucccuaggacuagacugugaaccaagaacaggcuuggauuuuagugacuuauauuaccuaacaaugaacaauaaacauuggcuaguucauaaagaaugguuucacgauauaccauuaccauggcacgcaggagcagauacaggaacaccacauuggaauaauaaagaagcgcuagucgaguucaaagaugcacacgcaaaacgacaaacaguagucguacuugguucacaagaaggagcaguucacacugcuuuagcgggugcauuagaagcagaaauggauggagcaaaaggaagacuauuuucaggacaucuuaaaugccgucuuaaaauggauaaauuaagacuuaaaggaguaaguuauucacuaugcacagcagcauucacauuuacuaaaguuccugcagaaacauuacacggaacagugacaguugaaguccaauacgcuggaacagaugguccauguaaggucccagcacaaauggcgguagauaugcaaacauugacaccaguuggaagacuaauuacagcaaauccaguaauaacagaaaguacagaaaauaguaaaaugauguuagaauuggacccacccuuuggagauaguuauauaguuauaggaguaggagauaagaaaauaacacaucacuggcauagaucuggaucaacgauaggaaaagcauuugaagcaacuguaagaggagcuaaaagaauggcaguacuuggagauacagcaugggacuucggcucaguaggcggugucuucaauucauuaggaaaaggaauacaucaaauauuuggcgcagcauuuaaaucacuauucggagguaugaguugguuuucacaaauacuuauaggaacccuuuuaguuuggcuaggacuaaauacuaaaaaugguucaaucaguuuaacauguuuggcauuaggaggaguuaugaucuuucuaagcacagcuguuagugcugauguaggguguagcguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4833 - RNA, 2359 nt, Artificial Sequence
  KF268950.1 prME-long mRNA Design 1 opt
gggagaaagcuuaccaugagaauuauaaaugcaagaaaagagagaaagagacgaggagccgacacaucuauaggaauaauaggacuacuauuaacaaccgcaauggcagcagaaauaacucgaagagggagugcauacuacauguauuuagaucgaucagacgcugguaaagccauaaguuuugcgacuaauuuaggaguaaacaaaugccauguucaaauuauggaccuaggacauaugugcgaugcaacaaugaguuacgaauguccaaugcuagaugaaggaguagaaccagacgauguagauugcugguguaauacaacaucaacauggguuguauacggaacaugucaucauaaaaaaggagaagcaagacgaucaagaagagcaguaacuuugcccucucacagcacaagaaaauuacagacccgaagccaaaccuggcuagaaucaagagaauauacaaaacaucuuauaaaaguugaaaauuggauauuuagaaaucccgguuuugcguuagcagcaguagcuauagccugguuacuuggaagcaguacaucacaaaaaguuauauauuuaguuaugauauuauuaauugcgccagcuuauucaauuagauguaucggaguaagcaaccgggauuucguugagggaaugucaggggguacauggguagauguaguauuagaacaugggggaugcguaacaguaauggcgcaagauaaaccaacaguagacauagaauuaguaacaacgaccgugucaaacauggcagaaguucgcucauauuguuaugaagcaaguauaucugauauggcaucagacucaagauguccuacacaaggugaagcauacuuagacaaacaaucugauacucaguacgucuguaaacgaacucuaguagacagaggauggggaaauggaugcggucuauuugguaaaggaucacuagugacuugugcaaaauuuacauguagcaaaaaaaugacagguaaaaguauucagcccgaaaaccuugaguauagaauaauguuaucaguccauggaucucaacauagugguaugauagucaaugauauaggccaugaaacagaugaaaauagagcaaaaguugaaguaacaccaaauucaccaagagcagaagcaacccuagggggauuuggaucacuuggauuagauugugaaccuagaacuggacuagacuuuucagacuuauacuauuuaacaaugaacaauaaacauugguugguacauaaagaaugguuucacgauaucccuuuacccuggcaugccggagccgauacaggaaccccacauuggaauaauaaagaggcacuaguugaauuuaaggaugcacaugcgaaaagacaaacaguaguaguacuaggaucacaagagggagccguacauacggccuuagcuggagcacuagaagcagaaauggacggagcuaaaggaagacuauuuagcgggcacuugaaaugccgauuaaaaauggauaaauuacgacuuaaaggaguuuccuacucauuaugcacagcugcauuuacguuuacuaaaguaccugcagaaacauugcacggaacaguaacaguagaaguacaauaugcugguacagauggacccuguaaagugccagcgcaaauggcuguggauaugcaaacauuaacuccuguuggaagacuaauaacagcaaauccaguaauaacagaaucaacugaaaacaguaaaaugauguuagaauuagacccuccauuuggggauucguauauaguaauagguguuggagauaaaaaaauaacacaucauuggcauagaagugggucgacaauaggaaaagcuuucgaagcaacaguaagaggagcaaaaagaauggcagucuuaggagacacagcaugggauuuuggaucaguuggaggugucuucaauaguuuagguaaaggaguacaccaaaucuucggagcagcuuucaaaagucuauuugggggaaugucaugguuuucacaaauacuuauuggaacauuacuagucugguuaggacucaauacaaaaaauggcaguauaagcuuaacauguuuggcauuaggaggcgugaugauuuuccuaagcacagcaguaucagcagacguagguuguaguguugauuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4834 - RNA, 2359 nt, Artificial Sequence
  KF383121.1 prME-long mRNA Design 1 opt
gggagaaagcuuaccaugcgaauaauaaacgcaagaaaagaacgaaaaagaagaggagcagacacaucaauuggaauaauaggucuguuauuaacaacagccauggccgcagaaauuacaagaagaggcagugcauauuauauguauuuagaccgaagugaugcuggaaaagcaauaucauucgcuacuacauugggagucaauaaaugucauguccaaauuauggaccuuggucauaugugcgacgcaacuaugucauaugaauguccgauguuagaugaggguguugaaccagacgacguagauuguuggugcaacacaacaaguacuuggguaguauauggaacaugccaucauaaaaaaggagaggcacgccgaaguagaagagcaguaacacuaccaucucacucaacaagaaaauuacaaacuaggucacaaacaugguuagagucacgcgaauacacaaaacauuuaauaaaaguagaaaauuggauauuuagaaauccaggauuugcacuuguagccguagccauagcuuggcuacuugguagcucaacaagucaaaaaguaauauauuuaguaaugauauuacuaauagccccagcauacaguauaaggugcauagguguaucaaauagagauuuuguagaagguaugucaggcggaacauggguagauguaguacuugaacacggaggaugcguaacaguaauggcgcaagacaaacccacaguagacauugaacuaguaacaaccacaguaagcaauauggcugaaguaagaucuuauuguuacgaagcaaguauaagcgauauggcaagugauucaagauguccuacacaaggcgaagcauauuuggauaagcaaagugacacucaauauguuuguaaaagaacuuuagucgacagaggauggggaaauggaugcggacuuuuuggaaaaggaagccuaguaacaugcgccaaauucacauguaguaaaaaaaugacaggaaaaaguauacaaccugaaaaccuagaguacagaauaaugcuuaguguacacggaagccaacacuccggaaugauuguaaaugauauuggucaugaaacagacgaaaauagagcaaaaguagaaguuaccccaaacucaccuagagcagaggcaacacuagguggauuuggcucauuaggauuagauugugaacccagaacagggcuagacuuuagugacuuauauuaucuaacgaugaacaauaaacauugguuaguccauaaagagugguuccaugauauaccccuaccauggcaugcgggagcagauacugguacaccacauuggaacaacaaagaagcauuaguagaauuuaaagacgcucaugcuaaaagacaaacuguaguaguauuaggaucacaagaaggugcagugcacacagcauuagcaggugcucuagaagcagaaauggauggagcaaaaggaagauuauucucagggcaucuaaaaugccgauuaaaaauggauaaauuaagauuaaaagggguaaguuauucauuauguacagcagcauucacuuuuacuaaaguaccagcagaaacauuacacgguacagucacaguagaaguacaauaugcaggaacagauggaccaugcaaaguaccagcacagauggcaguagauaugcaaacauuaacaccaguuggacguuuaauaacagcgaauccaguaauaacagaaucaacagaaaauaguaaaaugaugcuagaguuggauccgccauuuggggauucuuacauaguuauaggagugggugacaaaaaaauaacucaccauuggcacagaagcgguucaacaauaggaaaagcauuugaagcaacaguaagaggagccaaacgaauggcaguacucggagauacagcaugggauuuuggaucagucggagguguauuuaacucauuaggaaaagguauacaucagauauucggggccgcuuuuaaaucauuauuuggcggaaugucaugguucagucaaauauuaauuggcacuuuauugguuuggcuaggacuuaauacaaaaaaugggaguauaagccuuaccuguuuagcguuaggaggaguuaugauauuuuugucaaccgcaguaagugcggauguaggaugcaguguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4835 - RNA, 2341 nt, Artificial Sequence
  KF268949.1 prME-long mRNA Design 1 opt
gggagaaagcuuaccaugaggauuauaaacgcaaggaaagagagaaaaagacguggagccgauacaagcaucggaauaauaggccuauuacuaacaacagccauggcagcugagauuacaagaagaggaagcgcauauuacauguauuuagauagaagugaugcuggaaaagcaauaucauuugcaacaaauuuaggaguaaauaaaugucauguccaaauaauggacuuagggcacaugugcgaugcaacaaugagcuaugaauguccaauguuagaugaaggagucgaaccagaugacguagauuguugguguaauacaacaucaacauggguaguauacgguacuugccaucauaagaaaggagaagcgagaagaucaagacgagccgugacucucccgagucacaguacacguaaauuacaaacucgaucacaaacaugguuagaaucucgagaauauacaaaacauuuaaucaaaguagaaaacuggauauucagaaauccaggauucgcacuagccgcaguagcaauagcaugguuauuagggaguaguacuucucaaaaaguaaucuaucucguaaugauccuauuaauugcaccagcauauagcauacguugcauaggaguaagcaacagggauuuuguggaagguaugaguggaggaacauggguagauguaguauuagaacacggagguugcguaacuguaauggcccaagacaaaccaacaguagauauagaacucguaacaacaacaguaucaaauauggcagaaguaagaaguuauuguuaugaagccaguauuucagauauggcaucagacuccagaugcccgacacaaggggaagccuauuuagacaagcaaagugauacacaauauguauguaaacgaacauuaguugauaggggaugggguaauggauguggauuauucggaaaaggaucauuaguaacaugugcaaaauucacuuguuccaagaaaaugaccggaaaaucaauacaacccgaaaacuuagaauacagaauaaugcuaucuguacauggaucacaacacaguggaaugauaguaaaugacgaaaauagggcaaaaguagaagucacaccaaacagcccucgagcggaagcaacauuaggaggauuuggaagucuaggauuagacugugaaccaaggacuggucuagauuuuucggaccuauauuauuuaaccaugaauaacaaacauugguuaguacauaaagaaugguuucaugauauuccauuaccguggcaugcuggugcagauacaggaacaccgcauuggaacaauaaagaagcauuaguagaauuuaaagaugcacaugcaaaaagacaaacaguaguaguuuugggcagccaagaaggugcaguucauacugcacuggcuggagcucucgaagcagaaauggauggagccaaaggaaggcuauuuucaggacacuugaaauguaggcuaaaaauggauaaacuaagauuaaaaggcguaucauauucucuauguacagcggccuuuaccuuuacaaaaguuccagcagaaacucuacauggcacaguuaccguagaaguacaauaugcaggcacagauggaccaugcaaaguaccagcacaaauggcaguagacaugcaaacauuaacacccguagggagauuaauaacagcaaauccaguuauaacugaaucaacugaaaacagcaaaaugauguuggaacuagauccaccuuucggcgauaguuacauaguaauagguguaggagauaagaaaauaacacaucacuggcaucguaguggaagcacaauaggaaaagcauuugaagcaacaguaagaggggcuaaaagaauggcaguacuaggagauacagcuugggacuucggaucaguaggggguguauuuaauagcuuaggaaaaggcauacaccaaauauuuggagcagcauuuaaaaguuuauuugggggaaugaguugguucucacaaauauuaauaggaacuuuauugguuugguuaggucucaacacuaaaaacgguaguauaucauuaacaugucuagcacuaggaggaguaaugaucuuuuuaucaacagcaguaucagcagacguagguuguaguguagauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4836 - RNA, 2359 nt, Artificial Sequence
  KU955595.1 prME-long mRNA Design 1 opt
gggagaaagcuuaccaugcgaauaauuaaugcaagaaaagaaagaaaacguaggggagcagacacaucaauuggcauugucggauuauuauuaacaacugcuauggcagcagaaaucacaagaagagguagugcuuauuauauguauuuagauaggagugaugcaggaaaagcaauaucauuugcaaccacacuaggcguaaauaaaugucaugugcagauaauggauuuaggacauaugugcgaugcuacuaugaguuaugaauguccaauguuagaugaaggaguagaacccgaugauguagacuguugguguaacacaacgaguacaugggugguauauggaacaugucaucauaagaaaggagaagcaagaaggaguagaagggccguuacacuaccuagucauaguacaagaaaauuacaaacaagaagccaaacaugguuggaaagccgcgaauacacaaaacauuuaauaaaaguagaaaauuggauuuucagaaauccgggcuuugcccuaguagcaguagcaauugcaugguuacuaggaaguuccacaagucaaaaaguaauuuauuuaguaaugauauuacuaauagcgccagcauacucuauaagguguauuggaguaaguaauagagauuuuguagaaggcaugaguggaggaacuuggguagauguaguacuagaacauggaggaugugucacagugauggcccaagacaaacccacaguagauauagagcuaguaacaacuaccguaaguaacauggcggaaguaagaucauacuguuaugaagcaaguauaucagacauggcuuccgauaguagauguccgacacaaggagaagcguaccuggauaaacaaagcgacacacaauauguauguaaaagaaccuuaguagauagaggauggggaaaugguugugguuuauuuggaaaggguagcuuaguaacaugugcaaaauuuacauguucaaagaaaaugacgggaaaaucaauacaaccugaaaacuuggaauauagaauaaugcuaaguguacauggaucacaacauaguggaaugauaguaaaugauacaggacaugaaacggaugaaaaucgagcaaaaguggaaguaacgccaaacucaccaagagcggaagcgacauuaggagguuucggaucauuaggguuggacugugaaccacgaacaggacuagauuucagugauuuauacuauuuaacuaugaauaacaaacauugguuaguucauaaagaaugguuucaugauauaccauuaccauggcacgcaggcgcagauacgggaacaccacauuggaacaauaaagaagccuuagucgaauuuaaagaugcacacgcgaaacgccaaacuguaguaguuuuaggaucacaagaaggagcaguacauacagcauuagcuggugcauuggaagcggaaauggauggagcaaaaggaagauuauuuagcggucauuuaaaaugucgacuaaaaauggauaaauuaagauuaaagggaguaucauauucacuauguacagcagcauuuacuuuuaccaaaguuccagcugaaacauuacauggaacgguaacuguagaaguacaauaugcaggaacugauggaccuuguaaaguaccugcucagauggcaguugauaugcaaacauuaacaccuguaggacgauugauaaccgcaaauccagugauaacagaaucuacagaaaauaguaaaaugauguuggaauuagauccaccuuuuggugacaguuauauuguaauaggaguaggugauaagaaaauuacacaccacuggcacaggagugguaguacuauaggaaaagccuuugaagcuacaguaagaggagcaaaaagaauggcuguguuaggagauacagcuugggacuuugguucaguuggcggaguuuuuaauucguuagggaaaggcauucaucaaauauucggugcagcauucaaaagccuauucggaggaaugagcugguucagucaaauacuuauaggaacacuauuaguguggcuugguuuaaauacgaaaaauggaucaauaaguuuaacauguuuagcauuaggugguguaaugauauucuuaaguacagcaguaagcgcagauguaggauguucuguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4837 - RNA, 2359 nt, Artificial Sequence
  KF383116.1 prME-long mRNA Design 1 opt
gggagaaagcuuaccaugagaauaauaaaugcaagaaaagagcgaaaaagaagaggagcagacacaucuauugggauaguaggacuauuauuaacaacagcgauggcggcugaaauuacaagaagaggaagugcuuacuauauguacuuagaccgaagugaugcuggcaaagcaauaucguucgcuacaacacuugggguaaacaaaugccacguucaaauaauggacuuaggacauaugugugaugcuacgaugagcuacgaauguccaauguuagaugaagguguagaaccagaugacguagacuguugguguaacacaacaaguacauggguaguuuauggaacaugucaacacaagaaaggggaagcaagacguagcagacgagcagugacacuaccuagucauaguacuagaaaacuacaaacaagaucacagaccugguuagaaaguagagaauauacaaaacaucuaauaaaaguagaaaauuggauauuuagaaaucccggauuugcccuaguugcaguagcaauagcaugguuauuaggaucaagcacaagucaaaaaguaauauauuuaguaaugauauuacuuauagcaccagcuuacagcauuagauguauagguguaucaaauagagacuuuguggaggguaugagcggaggaacauggguugauguaguauuagaacauggaggcuguguuacuguaauggcucaagacaaacccacaguagauauagaauuaguaacgacaacaguaucgaauauggcagaagucagaucuuauuguuacgaagcgagcauaucagacauggcaagugauaguagaugucccacucaaggugaagcauauuuagacaaacaaucagauacacaauauguauguaaaaggacauuaguagaccgggguuggggaaauggaugcggacuauuugguaaaggcagcuuaguuacaugugccaaauuuacauguucuaagaaaaugacaggaaaaaguauacaaccagaaaauuuagaauauagaauuauguuaaguguacauggaagccaacauucaggaaugaucguaaaugacauuggacaugagacugaugaaaauagagcaaaaguagagguaaccccaaauucuccuagggcagaagcaacacucggaggauucggaaguuuaggacuagauugugaaccaagaacaggacuagauuuuucagauuuauacuaucuaacaaugaauaauaaacauuggcuagugcauaaagaaugguuucacgacauuccgcuaccauggcaugcaggagcagauaccggaacaccacauuggaauaacaaagaagcucugguagaauuuaaagaugcacaugcaaaaaggcaaacgguaguaguucuuggaucacaagaaggagcaguacacacggcauuagcaggagcauuagaggcugaaauggauggugcuaaaggucggcuauuuucaggucauuuaaaaugcagguuaaaaauggauaaauugagauuaaaaggaguaagcuauagucuauguacagcuguuugcacagcugcaaaaguaccagcagaaacauuacauggaacuguaacaguagaaguacaauacgcaggaacagauggaccuuguaaaguaccagcacaaauggcuguagauaugcaaacacuuaccccaguaggacgauuaauuacagcaaaccccguaauaacagagucaacggaaaauaguaaaaugauguuagaauuagacccucccuuuggugauucauacauaguaauaggaguaggagauaagaaaauaacacaccauuggcacagaucaggcucaacaaucggaaaagccuucgaagcuacaguacgaggagcaaaaagaauggcaguauuaggagauacugcaugggauuuuggcaguguaggaggaguauuuaauaguuuagguaaagguauucaucaaauuuuuggagcagcuuucaaaucauuauucggaggaaugaguugguuuucacaaauacuuauaggaacacuauuaguaugguuaggacuuaauacgaaaaacgggucaaucagcuuaacauguuuagcacuagguggcguaaugauauuucuuucaacagccguuagugcagauguaggcuguuccguugauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4838 - RNA, 2341 nt, Artificial Sequence
  KU963574.2 prME-long mRNA Design 1 opt
gggagaaagcuuaccaugagaauaauaaacgcuagaaaagaacggaagagaagaggagcugaugcgucaauaggaauaguaaguuuauuauuaacaacaguaauggcugcagaaauuacaaggagaggaucagcuuauuauauguauuuagacagaagugaugcgggaaaagcaauaaguuuuguaacaacauuaggaguaaauaaaugucauguccaaauaauggacuuggggcauaugugcgaugcaacaaugucuuaugagugcccaauguuggaugaaggaguugaaccagaugauguagauuguugguguaauacaacaucaacuuggguaguauacggaacaugccaccacaagaaaggggaagcuagaagaucaagaagggcaguaacauugccaagucauaguacgagaaaacuacaaacacguagccagacauggcuugaaucaagagaauauacaaaacacuugauaaaaguagagaauuggauuuuccgaaauccagguuucgccuuaguugcaguagcaauugcaugguuacuaggaagcagcacuucucaaaaaguaauauauuuaguaaugauauuacuaauagcaccagcauauucaauaagauguauaggagugaguaacagagauuucguagaagguaugaguggaggaacauggguagacguaguacucgaacacgguggaugcguaacaguaauggcucaagacaaaccaacaguagauauugaacucguaacaacaacaguaucaaauauggccgaaguuaggucuuauugcuaugaggcaucaauaucagacauggcaucagauagcagauguccuacacaaggagaagcauauuuagauaaacaaucagacacacaauacguaugcaaaagaacauuaguagauagaggcuggggaaacggcuguggacuguuugggaaaggaucucucguaacaugcgcuaaauucaccuguaguaagaaaaugacaggaaaaaguauacaaccagaaaaccuagaauauagaauuauguuaagcgugcauggaagccaacacagcgggaugauaguuaaugaugaaaauagggcaaaaguagaggucacgccaaacagcccaagagcagaagcaacauuaggagguuucggaagccucggauuagauugugaaccaaggacuggauuagauuucucagauuuauauuaucuuacaaugaauaacaaacacuggcuaguacauaaagaaugguuucacgauauuccauuaccauggcauucaggagcagacacugaaacaccacacuggaauaauaaagaagcguugguagaauuuaaagaugcacacgcaaaaagacaaaccguaguagucuuagguucgcaagaaggagcaguacauacagcacuagcaggcgcgcuagaagcugaaauggauggugcaaaaggaagacugucaucaggucaucuaaaauguagauuaaaaauggauaaauuaagacuaaaagguguaucauauuccuuauguaccgcagcguuuacuuucacaaaaguuccagccgaaacauuacauggaacaguaacuguagaaguacaauaugcagggcgagacggaccuuguaaaguuccagcacaaauggcaguugauaugcaaacauuaacaccaguugggagauuaauaaccgcaaacccaguaauaacugaaucaaccgaaaauucaaagaugauguuagaauuagaucccccauuuggagacuccuauauagugauaggaguuggagauaagaagauaacccaucauuggcauagaucaggaagcauuauaggaaaagcauuugaagcaacaguaagaggcgcaaaaagaauggcaguacuaggcgauacggcaugggacuuuggaucagugggaggaguuuucaacagucuaggaaaagguauucaccaaauauucggagccgcauucaaaagccuauucggagguaugucaugguuuucacagauucuaauaggaacgcuucuaguaugguugggauuaaauacuaaaaauggaaguauaucacuaacaugucuugcuuuaggaggaguaaugauauucuugucaacagcaguuucugcagacguuggaugcaguguggauuuuaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4839 - RNA, 2341 nt, Artificial Sequence
  KX601166.1 prME-long mRNA Design 1 opt
gggagaaagcuuaccaugagaauaauaaaugcaagaaaagaaagaaaaagaagaggagcugauacaucuauuggaauaguaggcuuguuauuaacaacagcuauggcagcagaaauaacaagaagaggaagcgcuuacuauauguauuuagacaggagugaugccggaaaagcaauaucauuugcaacaacauuaggggucaauaaaugucauguccaaauaauggacuuaggacauaugugcgacgcaacaaugaguuaugaguguccaauguuggacgaaggaguagaaccagaugauguagauuguugguguaauacgacuuccacauggguaguuuacggaacuugucaucauaagaaaggagaagcuagaagaagcaggagagcaguaacacuaccaucacauaguacuagaaaacuucaaacaagaagccaaacauggcuagagucaagagaauauacaaaacacuugauaaaaguagaaaauuggauauuuagaaauccaggcuuugcauuaguggcaguagcuauagccuggcuuuuaggaagcaguacaagucaaaaaguaauauauuuaguaaugauauuauuaauagcaccagcauauucaaucagaugcaucggagugaguaauagagacuucguagaagguaugagcggaggaacauggguagaugugguacuagaacacggaggcuguguaacaguaauggcacaagauaagccgaccguagauauugaauuaguaaccaccaccgugaguaauauggcagaaguuagaucauauugcuaugaagcaaguaucagugauauggcaagcgauaguagauguccgacacaaggagaagcauaccuagauaaacaaagcgacacacaauacguauguaaaagaacacucguagauagaggauggggaaacggauguggauuauuugggaaaggaucccuaguaacaugugccaaauuuacuuguucgaagaaaaugacuggaaaaaguauacaaccugaaaacuuagaauauagaauaaugcuaucaguacaugguagccaacauagcggaaugauaguaaaugaugaaaacagggcaaaaguagaaguaacgccuaauagcccaagagcagaagcuacacuagguggauuuggaaguuuaggacuagauugcgaaccacgaacgggguuagauuuuagugacuuauauuauuuaacuaugaacaauaaacauugguuaguacacaaagaaugguuucacgacauaccauuacccuggcaugcaggagcggauacaggaacaccacauuggaauaacaaagaagcucuaguggaauuuaaagaugcacaugcaaaaaggcaaacaguuguaguacugggaucacaagaaggagcgguucauacagcccuagcaggagcacuagaagccgaaauggauggagcgaaaggaagauuauucucaggacauuuaaaaugucgauuaaaaauggacaaacuacgauuaaaaggaguuaguuacucauuauguacagcagccuucacguuuacaaaaguaccagcagaaacacuacacggaacaguaacuguagaaguacaauacgcuggaacagauggaccuuguaaaguaccugcccaaauggcgguagauaugcaaacauuaacaccuguggguagguuaauaacagcaaauccaguaauaacugaaucaacagaaaacaguaaaaugauguuagaauuagauccacccuuuggugauagcuauauagucauaggaguaggugacaagaaaaucacacaucauuggcaccgaaguggcucaacgauagguaaagcauucgaagcaacaguucgaggagcuaaaagaauggcaguacuaggagauacagccugggauuuugggaguguagguggaguauucaauagccuagggaaaggaauacaccaaauauucggggcagcauucaaaagucuauuuggugguaugaguugguuuucacaaauauuaauaggcacuuuauuaguauggcuaggguuaaauacuaaaaacggaagcauuagcuuaacaugccuagcgcugggagguguaaugauauuucuaaguacagcaguaagugcagauguaggauguagcguugauuuuucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4840 - RNA, 2359 nt, Artificial Sequence
  KF383118.1 prME-long mRNA Design 1 opt
gggagaaagcuuaccaugagaauuauaaaugcaagaaaagaaagaaaaagaaggggagcugacacuucaauaggaauaauaggauuacuacuuaccacagcaauggcagcagaaauaacacgaagaggaucugcauauuacauguaucucgauagaagcgacgcagguaaagccauaaguuuugcaaccacauuagguguaaauaagugucauguacaaaucauggacuuaggacauaugugugacgcaaccaugagcuaugaaugcccuaugcuagacgaaggaguagaacccgaugacgucgacuguuggugcaacacuacaagcacaugggucguuuaugguaccugucaucauaagaaaggagaaacucgaagaucaagaagaaguguaucucuuagauaucauuacacaagaaaacuacagacaagaucucaaacauggcuagaaucaagagaauauaagaaacaucuaauaaugguugaaaauuggauauucaggaacccaggauuugcaauaguuaguguugcaauaacauggcuuaugggaaguuuaacaagccaaaaaguuauauacuuaguaaugauaguucuaauuguaccagcuuauucaauaagcugcauaggagugaguaacagagauuuagucgaaggaaugucagguggaacauggguagauguaguauuagaacaugggggaugcguuacagaaauggcccaagauaaaccgacaguagauaucgaauuaguaacaaugaccguaucaaacauggccgaaguaagaucauauuguuaugaagcaucacuaucagauauggcaagugcaagcagaugcccaacucaaggggaaccaucucuagauaaacaaucagacacacaaucaguaugcaaaagaacauugggugauagaggauggggcaacggcuguggcauuuuuggaaaaggaagucuaguuaccuguaguaaauucacgugcuguaagaaaaugccaggaaaaaguauucaaccagaaaaccuugaauacagaauuauguuaccaguacauggaucgcaacauaguggcaugauagugaaugauauaggucacgaaacagacgaaaauagagcaaaaguugaagugacaccaaacaguccaagagcagaagcaacauuaggaggauuuggaucauuaggauuagauugugaaccacgaaccgggcuagauuucagcgaucuuuauuacuuaacgaugaauaauaaacacuggcuaguacauaaagaaugguuccaugacauaccauuaccauggcacgcaggagcagauacuggaacuccacauuggaauaauaaagaagcacuuguugaguucaaagaugcacaugcaaaaaggcaaacaguaguaguacuaggaagccaagaaggagcuguucacacagcguuagcaggcgcacuugaagcugaaauggauggagcaaaaggaagauuguuuucaggacauuuaaagugcagacuuaaaauggacaaacuaagacuaaaaggcgucucuuacucauuauguacagcagcauuuacauucacuaaagugccagcagaaacacuacauggaacugucacaguagaaguccaaucugcagguacagauggcccauguaaaguacccgcccaaauggcaguugacaugcaaacgcugacaccaguagguagacuaauaacagcaaacccuguaaucacagaaucaacagaaaacuccaaaaugauguuagaacuagauccaccuuucggagauaguuauauuguaauuggaguaggagauaagaaaauaacacaucauuggcauagaagcggaaguacuauaggaaaagccuucgaagcuacaguaagaggcgcuaaaaggauggcugucuuaggugauacagcuugggauuuuggaucaguaggggguguauucaauagucuaggaaaaggaauacaucaaauuuuuggagccgcguucaaaaguuuauucggagguaugucgugguuuucacaaaucuuaauaggaacauuacugguauggcuaggacuaaauacuaaaaauggcaguauuagcuuaacauguuuagcuuuaggaggaguaaugauauuucuuagcacagcaguuagugcggaugucggauguucuguagacuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4841 - RNA, 2353 nt, Artificial Sequence
  KF383120.1 prME-long mRNA Design 1 opt
gggagaaagcuuaccaugagaauuauuaacgcucguaaagaaagaaaaagacguggugcagacacaagcauagggauaauagguuugcuauuaacaacugcaauggcugcugaaauaacaagacgaggaucagcauauuauauguaccuggauaggucugaugcaggaaaagcaauaucauucgcaacuacaaugggaguaaauaaaugucauguacaaauaauggauuuaggacacaugugugaugcuacaaugaguuaugaauguccuauguuagacgaaggaguagaaccugaugauguugacuguugguguaauacuacuagcacauggguuguauaugggaccugccaucauaagaaaggagaagcaaggccaucaagacgagcagucacauuaccgagucauaguacucgaaaauuacaaacucgaagucaaacgugguuagaaucacgugaauacacaaaacacuuaauaaaaguagaaaauuggauacuucgaaacccuggguuuacgguagcagccuuagcaauggcauggcuucuaggaaauaguacaagucaaaggguaauauaccuaguaaugauuuuauuaauagcacccgcauauucaauaagaugcauaggaguaagcaauagagauuuuguagaagguaugucaggaggaacauggguagauguuguacuagaacacggcggaugcguaacaguuauggcucaagacaaaccaacaguagauauagaauuaguaacuacaacaguaucaaauauggcugaaguaaggaguuauuguuaugaggcaaguaucucagauauggcaagugacaguaggugcccaacccaaggcgaggcuuaucuagauaaacaaagugauacucaauacguauguaaaaggacgcuaguagauagaggauggggaaacgguuguggacuauuuggaaaaggaagccuaguaacaugugccaaauuuacauguucaaagaaaaugacaggaaaaaguauacaacccgaaaaucuagaauauagaauuaugcuaaguguacauggaucucaacacucaggaaugauaguaaaugacauaggacaugaaacagaugaaaauagagcaaaaguggaaguuacaccaaauaguccaagagcagaagcuacacuggguggauucgggagcuuaggguuagauugugaaccaaggacaggauuagauuucucagaucuauacuaucuaacaaugaacaacaaacauugguuaguucauaaagaaugguuucacgacauaccacuaccauggcacgcaggagcagauacaggaacaccacauuggaacaauaaagaagcauuaguagaguucaaagacgcacaugcuaaaagacagacaguaguuguucuaggaagccaagaaggagcuguacauacagcacuugcaggagcacuugaagcagaaauggauggugcaaaagggagacuuuucagcggacacuuaaaaugccgaauaaaaauggauaaauuaagauuaaaaggugucucguauucuuuauguacagcagcauuuacauuuaguaaaguaccagcagaaacauuacaugguacgguaacagucgaaguacaauaugcaggaagagauggaccauguaaaguaccagcacagauggcaguagauaugcaaacauuaacaccuguagggagauuaauaacggccaauccuauaauaacagaaaguacagaaaauucacgcaugaugcuugaacucgauccaccauucggagauaguuauauagugauaggaguaggugauaagaaaauaacccaucauuggcauagaaguggaaguacuauagguaaagcauucgaagcaacagugagaggagcuaaacgaauggcaguauuaggcgauacagcuugggauuuugguaguguagguggaguauucaauagucuaggaaaaggaguacaccaaguauucggagcggcauuuaagagcuuguucggaggaaugagcugguucucacaaauacuuauagguacauuauuaguauggcuaggauuaaauacuaaaaacggaaguauuucauuagcaugucuugcucuagguggugcaaugauuuuucuaagcacugccguuucugcagacguugguuguagcguagauuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4842 - RNA, 2284 nt, Artificial Sequence
  KU321639.1 prME-short mRNA Design 1 opt
gggagaaagcuuaccaugacuagcguaggaauaguaggauuauuauuaacgacagcaauggcugcagaaguaacucgacgcggaucagcauauuauauguaccucgacagaaaugacgcaggagaagcaauuaguuucccuacaacauuagggaugaauaaauguuauauccaaaucauggauuuaggacacaugugugaugcaacaaugagcuacgaauguccaauguuagacgaagguguagaaccagacgacguagacuguuggugcaauacaacaucaacauggguaguauaugguacaugccaucauaagaaaggcgaagcuagaagaaguagacgagcaguaacacuaccaucacauagcacaagaaaauuacaaacaagaucucaaaccuggcuagaaucaagagaauauacuaaacauuugauaagaguagaaaauuggauauuuagaaauccaggauucgcuuuagcagcagcugccauugccuggcuuuuaggaucaucaacaagccaaaaaguaauauauuuaguaaugauauugcuuauagcgccagcauacagcauaagauguauaggaguuucaaauagagauuuugucgaaggaaugagcggaggaacauggguagauauaguacuugaacauggaggaugcgugacaguuauggcccaagacaaaccuaccguagacauagaauuaguuacaacuacuguaucuaauauggccgaaguaagaaguuauugcuacgaggcuucaauuagugacauggcaucagauucuagaugcccaacucaaggugaagcauaccuagacaaacaaagugacacgcaauacgucuguaaaagaacauuaguagacagaggauggggcaauggaugcggauuauucggaaaaggcagcuuaguaacuugugcaaaauucgcauguagcaagaaaaugacaggaaaaucaauacaaccagaaaacuuagaauacagaaucauguugucaguucauggcagccaacauucaggaaugauaguaaacgauacuggacaugaaaccgaugaaaauagagcaaaaguagaaauaacuccaaauaguccuagagccgaagccacauuaggugguuuuggaucauuaggacuagauugugaaccacgaacaggacuagauuuuagugauuuauauuaucuaacgaugaauaauaaacauugguuaguacauaaagaaugguuucaugauauaccacuuccauggcaugcaggagccgauacuggaaccccacacuggaauaauaaagaagcauuaguugaguucaaagaugcccacgcaaagagacaaacaguaguaguauuaggaucacaagaaggggcaguacauaccgccuuagcuggagccuuagaagcagaaauggacggagcuaaaggaagacugaguagcggacacuugaaaugucgacugaaaauggauaaguuaagguuaaaaggaguaaguuauaguuuauguacagcugcauuuacauuuaccaaaauaccagccgaaacccugcaugggacgguuacaguagaaguacaauaugcaggaacggauggaccauguaaaguaccagcgcagauggcaguugauaugcaaacacuaacaccaguaggaagacuuauaaccgcaaauccggugauaacagaaaguacagaaaacuccaaaaugauguuagaauuagauccaccauuuggagacucauauauagugauaggagugggagaaaagaaaauaacacaccauuggcauagaaguggaaguacaauaggaaaagcguucgaagcaaccguaagaggagcaaaaagaauggcaguucuaggagauacugcaugggauuucgguagcguaggaggagcauuaaauucacuaggaaaaggaauccaucaaauauuuggagcagcauucaaaaguuuauucggaggaaugaguugguuuucccaaauacuaauaggaacacuauuaaugugguuaggauugaauacgaaaaauggaucuauaucgcugaugugucuagcauuaggaggagucuuaauuuucuuaucaacagcaguaucagcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4843 - RNA, 2284 nt, Artificial Sequence
  KU312312.1 prME-short mRNA Design 1 opt
gggagaaagcuuaccaugacaucaguuggaauagucggacuucuuuugacaacagcaauggcugcugaaguuacgcgaagaggaagugccuauuacauguauuuggacagaaaugaugcaggagaggcuauuucauucccaacaacauuagggaugaacaaauguuauauacaaauaauggaucuuggucauacaugcgacgcgacgaugucauacgaauguccaaugcuugaugaaggaguagaaccugacgauguagacuguuggugcaacacaacaucaacuuggguaguauauggaacuugucaucacaaaaaaggggaggcaaggagaucacguagagcaguuacacuaccuucacauaguacaagaaaacuacaaacaagaucacaaacauggcucgaaucacgagaauauacaaaacauuuaauaaggguagaaaauuggauuuucagaaacccaggauuugcccuugcagcagcagcaauugcauggcuuuuaggaaguagcacaagucagaaagugauauacuuagugaugauuuuacuuauagcuccagcauauucuauaagaugcauaggaguaaguaauagagacuucguagaaggaaugaguggggguacuuggguagauguuguacuugaacacggcggaugcguaacaguaauggcccaagauaaaccaacuguagauauagaauuaguaacgacaacaguuucaaauauggcagaaguaagaucauauugcuacgaagcauccauaucagacauggcuucugauucuagauguccaacucaaggugaagccuauuuagauaaacaaucagauacucaauauguauguaaaagaaccuuaguagacagagguuggggaaauggaugcggauuauuuggaaaaggaagucuaguaacgugugcaaaauuugcaugcaguaaaaaaaugacuggaaaaaguauucaaccagaaaaccuugaauauagaauaauguugaguguacaugguagccaacauucaggaaugauaguaaaugauacaggccacgaaacagacgaaaauagagcaaaaguugaaauaacaccaaauagucccagagccgaagcaaccuuaggaggauucggaucucuaggauuagacugcgaaccuagaacaggacuagacuuuucagaucuuuacuauuuaacaaugaauaauaaacauuggcuagugcauaaggaaugguuucacgauauaccauuaccauggcaugcaggagcugauacagguacaccacauuggaauaauaaagaagcacuuguagaauucaaagacgcacacgcuaaacgacaaacaguaguaguauuagguagucaagaaggagcaguucauacagcauuagcuggggcauuagaagcagaaauggauggagcaaagggaaggcuaucaucaggacauuuaaaaugcagauuaaaaauggauaaauugagacucaaagguguaucauauucucuauguacagcagcuuucacuuuuacaaaaauaccagcagaaacucuucaugggacuguuacaguugaaguacaauaugcaggaacagaugguccaugcaaaguaccagcacaaauggcaguagauaugcaaacauuaacaccaguaggaagacugauaacagcaaacccaguaauaacagaaagcacagaaaauucaaaaaugauguuagaauuagauccuccauucggagauucauauauagucauaggaguaggagaaaaaaaaauaacacaucauuggcauagaucaggaucaacuauaggcaaagcauuugaagcaacaguaagaggcgcaaaaagaauggccguacuaggagacacagcuugggacuucggaagcguaggaggagcacuaaauaguuuaggaaaaggaauucaccaaauauuuggagcagcauuuaaaaguuuauucggaggaaugagcugguucucacaaauauuaauagguacuuuacuaaugugguuaggacuaaaugccaaaaacggaucaauaagcuuaaugugcuuagcucuuggaggugugcuaauauuccuuucaacagcaguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4844 - RNA, 2272 nt, Artificial Sequence
  AY632535.2 prME-short mRNA Design 1 opt
gggagaaagcuuaccaugacaucaauuggaauaauuggucuuuuacuuacuacagcaauggcagcagaaauaacaagaagaggaucagcauauuauauguauuuagaccguagcgaugccggaaaagcaauaucauucgcuacaacauuaggaguuaauaaaugucauguucaaauaauggacuuaggacauaugugugaugcaacuaugucuuaugaauguccaaugcuagacgaaggaguagaaccagaugauguagauugcugguguaauacuacuagcacauggguuguauaugguacaugucaucauaagaaaggcgaagcuagaagaaguagacgagcaguaacuuuaccaucucauucgacaagaaaauugcagacgagaucacaaacaugguuagaaaguagagaauauacuaaacauuuaauuaaaguagaaaacuggauauuuagaaauccggguuuugcauuaguggcagucgcuauugcaugguuauuaggcucaucaacgagucaaaaaguaauauaucuaguaaugauacuauugauagccccagccuauucaauaagaugcauaggaguaaguaauagagauuuuguagaagguaugagcggaggcacuuggguagaugucguuuuagaacacggaggaugcguaacaguaauggcucaagacaaaccaaccguagauauagaguuaguuacaacaacaguaaguaauauggcagaaguucgaucuuacuguuaugaagcaucaauaucagauauggcuagcgacucuagaugccccacacagggagaagccuacuuagauaaacaaagugauacccaauacguauguaaaagaacccuaguagauagaggauggggcaaugggugcggacuauuugguaaaggaucucuagugacaugcgcaaaauucacaugcucaaagaaaaugacaggaaaaaguauccaaccagaaaauuuagaauauagaauaauguuaucuguacauggcucacaacauucagguaugauaggauaugaaacugaugaagacagagcaaaaguagaagucacaccaaacuccccaagagcagaagcaacacuuggcggguuuggaaguuuaggauuagacugugaaccuagaacaggauuagacuucagugauuuauauuaccuaacgaugaacaauaaacacugguuaguacauaaagaaugguuucacgacauaccauuaccguggcaugcaggagcagauacuggaacaccucauuggaacaauaaagaagcauuggucgaguucaaagaugcucaugcaaaaagacaaaccguaguaguauuaggaucacaagaaggagcuguacauacagcauuagcaggagcgcuagaagcagaaauggauggagcaaaaggaaggcuauucucaggccaucuaaaauguaggcuuaaaauggauaaacuacgacugaaaggaguaaguuacucauuauguacagcagccuucaccuucacgaaaguaccagccgaaacucuacacggaacaguaacuguagaaguacaauaugcagguacagauggacccuguaaaauaccaguacaaauggcaguagauaugcaaacauuaacaccaguaggaagauuaauuacugcaaauccaguaauaacagaaaguacagaaaauucaaaaaugaugcuugaacuugaucccccauuuggagauucauauauaguaauaggaguaggagauaagaaaauaacacaucauuggcauagaucaggaucgacaauuggaaaagcauucgaagcaacaguaagaggagcgaaaagaauggcuguauuaggagacacagcgugggauuuuggaucagugggaggugucuuuaauagcuuaggaaagggaauacaccaaauauucggugccgcguuuaaaucacucuuuggaggcaugucaugguucagucaaauacuaauaggaacucuguuaguguggcuaggauuaaauacgaaaaauggaagcauuagcuuaacauguuuagcauuaggaggagugaugauauuccuaaguacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4845 - RNA, 2284 nt, Artificial Sequence
  KU527068.1 prME-short mRNA Design 1 opt
gggagaaagcuuaccaugacaucaguaggaauuguuggauuauuacuaacaacagcuauggcagcugaggucacaagaagaggaucugcauauuauauguauuuagauaggaaugaugcaggagaagcuauaaguuucccgacaacccuagguaugaauaaauguuauauucaaauaauggaucuaggacacaugugugaugcuacaaugucauacgaaugcccuauguuagaugaaggcguagaaccagacgauguagauugcugguguaauacaacgagcacauggguaguauauggaacuugccaucauaagaaaggagaagcuagaagaaguaggagagcuguaacauuaccuagucauaguacaagaaaauuacaaacaagaucgcaaacaugguuggaaucaagagaauauacgaaacauuuaauaagaguagaaaauuggauauuuagaaauccaggguucgcuuuagcagcggcugcuauugcaugguuauuagggaguagcacuucacaaaaaguaauauauuuagugaugauauuauuaauagcuccagcauauucaauaagaugcauaggagugucaaauagagauuucguagaaggaaugucggguggaacauggguagauguaguuuuggaacauggcgguugcguaacaguaauggcucaagacaaaccuacaguagauauagaauuaguaacaacaacaguaaguaauauggcagaaguuagaucuuauugcuaugaagcaucaauuucagauauggcaagugacucacgaugccccacacaaggggaagcauaccuagacaaacaaucagauacucaauacguauguaaaagaacauuaguagaccgggguuggggaaacggaugcggucuauucggaaaaggaagucuaguaacaugugcuaaauuugcauguaguaagaaaaugacagggaaaaguauucagccugaaaacuuagaauauagaauaaugcugucuguacauggaagucaacauagugguaugauaguaaaugauacaggacaugaaacagacgaaaauagggcaaaaguggagaucacgccaaacaguccuagagcagaagcuacacuaggagguuuuggaagucuagggcuagauugugaacccagaacuggauuagauuuuucggauuuauacuacuuaacaaugaacaacaaacacugguugguccauaaagaaugguuucaugauauaccauuaccauggcaugcgggcgcagauacaggaacaccacauuggaauaacaaagaagcauuagucgaauuuaaagaugcccaugcaaaaagacaaaccgugguagucuuaggaagucaagaaggagcaguacauacagcacuagcuggcgcgcuugaagcagaaauggauggagcuaaaggaaggcuaucgucaggacauuuaaaauguagguugaaaauggauaaacuaaggcuaaaaggaguuaguuauagcuuguguacugcagcauucacguuuacaaaaauaccagcagaaacauuacacgguacaguuacaguugaaguacaauaugcagggaccgauggaccauguaaaguacccgcacaaauggcuguagauaugcagacacuaacacccguaggaagacuaauaacagcaaauccugucauaacagaaaguacagaaaacucaaaaaugaugcuugaauuagauccaccauuuggagauucuuacauaguaauaggaguaggagaaaagaaaauaacucaucacuggcaucgaaguggaaguacaauaggaaaagcauuugaagcaaccguuagaggagcaaaaagaauggcaguauuaggagacacagcuugggauuuuggaagcguaggaggagcauuaaacucauuagggaaagguauacaucaaauuuucggagcagcauuuaaaagucuauuugggggaaugucaugguuuagucaaauauuaauagguacauugcuaaugugguuaggacuaaauacuaaaaauggaaguauaaguuuaauguguuuagcacuuggaggaguacuaauauuuuuaagcacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4846 - RNA, 2284 nt, Artificial Sequence
  KX421193.1 prME-short mRNA Design 1 opt
gggagaaagcuuaccaugaccucaaucgguauuauaggacuacuauuaacaacagcaauggcggccgaaauaacgagaagaggaucagcauauuacauguaucuagaccgaagugaugcaggaaaagcaauaucuuuugcuacaacacuaggaguaaacaaaugucauguacaaauuauggacuuaggacauaugugugacgcgacaaugucauacgaaugucccauguuagaugaaggaguugaaccagaugauguagacuguugguguaacacaaccaguacuuggguaguauacgguacaugccaucacaagaaaggagaagcaagaagaaguagacgagcagugacauuaccaagccacucaacgagaaaauuacaaacaagaagucaaacauggcuagaaaguagagaauacacuaaacaucuaauaaaaguagaaaauuggaucuucagaaauccaggauuugcauuaguagcaguugcaauugcaugguuauuaggaucaucaaccagccaaaaaguuauuuauuuaguaaugauccuauuaauugcaccagcauacaguauuagaugcaucggcguuucaaauagagauuuuguugaagguaugucaggaggaacauggguagauguaguauuagaacaugguggauguguaacuguuauggcacaagauaaaccuacaguggacauugaauuaguaacaacaacaguauccaacauggcagaaguuagaucauacugcuaugaagcaagcauaagugacauggcuucagauucaagauguccuacacaaggagaagcauaucuggacaaacaaucagauacucaauaugucugcaaaagaacauuaguugauagaggcuggggaaaugggugcggcuuauucggaaaagguagucuagucacaugcgcuaaauuuacauguaguaagaaaaugacaggaaaaucaauccagccagaaaacuuagaauacagaauuauguugucaguacauggaucucaacauagugguaugauuguaaacgauacaggauacgaaacagaugaaaauagagccaaaguagaaguuaccccuaacucaccaagagcagaagcaacucuaggaggauuuggauccuuaggacuagauugugaaccaagaacaggcuuagauuuuucagaucuauauuaccuuacaaugaacaauaaacacugguuaguacauaaagaaugguuccacgauauaccacuaccauggcacgcaggagcggacaccgguacaccacacuggaauaauaaagaagcauuaguugaguucaaagaugcucaugccaaaagacaaacaguaguaguuuuaggaucucaagaaggagcaguacauacagcuuuagcaggagcauuagaagcagaaauggacggagcaaaaggaaaauuauuuucaggacauuuaaaaugcagauuaaaaauggacaaauugagauuaaaaggcguaaguuauucacuauguacggcagcauucacauuuacuaaagucccagccgaaacacugcauggaacaguuacaguagaaguucaguacgcaggcacagauggaccaugcaaaauaccuguacaaauggcaguagauaugcaaacccuaacaccagucggaagacuuauaacugccaauccaguuauaacagaaucaacugaaaacuccaaaaugauguuagaauuagauccaccauuuggagacaguuauauaguaauuggaguaggagacaagaaaauuacacaucacuggcaucgaaguggaaguacaauaggaaaagcauuugaagcuacaguaagaggagcuaaaagaauggcaguacuaggugauacagcaugggauuuugguucuguaggagguguauuuaauagucuuggaaaaggaauacaucaaauauuuggagccgcauuuaaaucauuauuuggaggaaugucaugguucucacaaauacuaauuggcacauuauuaguauggcuaggacuaaacaccaaaaacggaagcauaaguuuaacaugucuagcacuaggaggaguaaugauauuucuaaguacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4847 - RNA, 2284 nt, Artificial Sequence
  KX377335.1 prME-short mRNA Design 1 opt
gggagaaagcuuaccaugacaucaauaggaauuauuggucuacuucuaacaacagcaauggcugcagaaauaacaagaagaggaagugcauauuacauguauuuagacagaucagacgcuggaaaagcgaucaguuucgcaacaacuuuaggaguaaauaaaugucauguacaaauaauggauuuaggucacaugugugacgcaacuauguccuaugaauguccaauguuagacgaaggaguugaaccagaugauguugauuguugguguaauacaacaucuacaugggucguauauggaacaugucacaggaaaaaaggggaagcaagaagaucuagaagggcaguaaccuuaccaagucauucaacaagaaagcuacaaacaagaagccaaacauggcuagaaaguagagaauacacuaaacacuuaauuaaaguagaaaauuggauauuuagaaauccaggauucgcauuaguugcaguagcaauagcaugguuauuaggcucgucaacaagucaaaaaguuaucuauuuaguaaugaucuuacuaauagcuccagccuauucaauuaggugcaucggcguaucaaauagagacuuuguagaaggaaugagcggagguacauggguagacguaguauuagaacauggaggaugcguaacaguuauggcucaagauaaaccaaccguagauauagaacuaguaacaacaacaguuaguaauauggcagaaguuagaagcuauugcuaugaagcgucuauaucagauauggcaucagauaguagguguccaacacagggagaagcauacuuagacaaacaaucggauacucaauauguauguaaaagaacauuaguagauagaggcugggguaacggaugcggauuauucggaaaaggaucauuagugaccugugcuaaauuuaccugcucaaaaaaaaugacgggcaaaucaauacaaccugaaaaucuagaauaccgcauaaugcuuaguguacauggaucccagcauucaggaaugauaguaaacgauacaggcuacgaaacagaugaaaauagagcaaagguagaaguuacaccuaauucaccacgagcagaagcaacauuaggaggauuuggaagucuagguuuagauugugaaccaagaacaggauuagauuuuucagaucuauauuauuuaacaaugaacaauaaacauuggcuaguacauaaagaaugguuucaugauauaccauuaccuuggcaugcaggugcagauacaggaacaccucauuggaauaauaaagaagcccuugucgaguucaaagaugcacacgccaaaagacaaacuguagucguacuaggaagucaagaaggugcaguacacacagcuuuagcaggagcacucgaagcagaaauggacggagcgaaaggaaaacuguucagcggacauuuaaaaugccgauuaaaaauggacaaauugagacuaaaaggaguaucauacucuuuauguacagcagcauuuacauuuacaaaaguuccagcagaaacauuacauggaacaguaaccguagaaguacaauaugcaggaacugacgguccaugcaaaauaccaguucaaauggcaguagacaugcaaacauuaacuccaguggguaggcuaauuacagcaaacccuguaauaacagaaagcacggaaaacucuaaaaugauguuagaacuagauccaccauuuggagauucauacauaguaauuggaguaggagauaaaaaaauuacacaucauuggcauagaaguggaucaacaauaggaaaagcauucgaagcaacuguacgaggggcaaaaagaauggcaguacuaggcgacacagcaugggauuuuggaaguguuggggguguauuuaauucuuuaggaaaaggaauacaucaaauauuuggagcggcauucaaaucauuauuuggaggaaugagcugguuuagucaaauuuuaauagguacuuugcuaguaugguuaggauuaaauacaaaaaacggaucaauaagccuaaccuguuuggcuuuaggaggaguaaugauauucuuaagcacagcagucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4848 - RNA, 2284 nt, Artificial Sequence
  LC002520.1 prME-short mRNA Design 1 opt
gggagaaagcuuaccaugaccagcauaggaauaaucggacuguuauuaacgacagcuauggcagcugaaauaacaagaaggggauccgcguacuacauguacuuagauagaucugaugcuggaaaagcaauaucauucgcuacaacacucggaguaaacaaaugucauguacaaauaauggaucuaggacacaugugugaugccacaauguccuacgaauguccuauguuagaugaaggaguugagccagaugauguagauugcugguguaauacaacuuccacauggguaguauauggcacaugccaucacaagaaaggagaagcuagaagaaguaggagagccguaacacuaccaagccauaguacaaggaaauuacaaacaagaagucagacuuggcuagaaaguagagaauauacaaaacaucugauaaaaguagaaaauuggauauucagaaauccaggauuugcucuaguagcaguagcaauagcaugguuauuaggaagcucaacaagccaaaaaguuaucuauuuaguaaugauauuauuaauagcuccagcguauuccauaagaugcauaggaguaaguaauagagacuuuguagaaggaaugaguggugggacauggguagauguugucuuagaacaugggggauguguaacagugauggcucaagacaaaccaacaguugacauagagcuaguaacuacaacaguaaguaacauggcagaaguaagaucauacuguuaugaagccuccauaucagauauggcauccgacagucgauguccaacacaaggugaagcauauuuggacaaacaaagugauacacaguauguaugcaagagaacauuaguugauagaggaugggguaacggguguggauuauuuggaaaagguucacuggugacaugugcaaaauuuacaugcucaaagaaaaugacuggaaaaagcauacaaccagaaaauuuagaauauagaauuauguuaucaguucacggaagccaacauaguggaaugacuguaaaugacauaggauaugaaacagacgaaaacagagcaaaaguugaaguaacgccaaauucaccuagagcagaagcuacauuaggaggauuuggcaguuugggauuagauugugaacccagaacaggacuugacuucagugauuuauauuaucugacaaugaacaauaaacauugguuaguacauaaagagugguuucaugauauaccauuaccguggcaugcaggagcagacacaggaacuccacacuggaacaauaaagaagcucuaguagaauuuaaagacgcacacgcuaaaagacaaacaguaguagucuuagggucacaagaaggcgcaguacacacagcuuuagcaggagcauuagaagcagaaauggacggcgccaaaggcaaacuauuuucuggccauuuaaaguguaggcuaaaaauggacaagcuaagauuaaaagggguaucauauucauuaugcacagccgccuuuacauuuacaaagguuccagcagaaacacugcauggaacagugacaguagaaguccaauaugcaggaacagauggaccauguaaaauaccaguacaaauggccguagacaugcaaacauuaacaccaguaggaagacucauaacagcaaacccugucauuacagaaagcacagaaaauucuaaaaugaugcuagaauuagauccaccuuuuggagauucuuauaucgugauaggaguuggagauaagaaaauaacacaucauuggcauagauccggaaguacaauaggaaaagcguuugaagccacaguaaggggagcaaaaaggauggcaguacucggagauacagcgugggauuuugggucaguuggaggaguuuuuaauagucuaggaaaagguauacaccaaauauuuggggcagcauucaaaucuuuauucggaggaaugagcugguuuucacaaauauuaauaggcacacuacuuguaugguuaggauuaaauaccaaaaauggaucaauaaguuugacaugccuagcgcuaggagggguaaugauauuucugucaacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4849 - RNA, 2266 nt, Artificial Sequence
  DQ859059.1 prME-short mRNA Design 1 opt
gggagaaagcuuaccaugacaaguauagguauaguaggccuucuacuaacgacagcaauggcagcugaaauaacaagaagagguucagcauauuauauguaucuagauagaagugacgcaggaaaagcuauuagcuucgcaacuacuuuaggaguuaauaaaugucauguacaaauaauggacuuaggacauaugugcgaugcaacaaugaguuaugaaugcccaauguuagaugaaggaguagaaccagacgauguagauugcuggugcaauacuacaucgacauggguaguguacggcacaugucaucacaagaaaggagaagcgagaagaucaagaagggcaguaacacuaccaagccauaguacgagaaaauuacaaacacgaucucaaacaugguuagaaucaagagaauauacaaaacacuuaauaaaagucgagaacuggauauuucggaauccaggauucacccucguugcaguagccauagcuuggcuacuaggauccucaacuagccaaaaaguaauuuauuuaguaaugauauuauuaauagcuccagcauauucaauaagauguauagguguaucuaacagagauuuugucgaaggcaugucaggaggaacauggguagauguaguucuagaacauggaggaugcguaacaguuauggcacaagacaaacccacuguagauauagaauuaguaacgacaacaguaucaaauauggcagaaguacgaagcuauugcuaugaagccucaauaucagacauggcuucagauucaagauguccaacacagggugaagcauaucucgacaaacaaucggacacacaauauguauguaaacgcacauuaguagauagaggaugggguaauggaugcggucuauucggaaaaggaucauuaguaacaugugcaaaauucacuugcucuaagaaaaugacgggaaaaucaauucagccagagaauuuagaauaccguauaauguuaucuguucauggaucacaacauucugggaugauaguaaaugaugaaaauagagcaaaaguagaagugacaccaaauucaccaagagcagaagcuacacuaggaggauuuggaucacuaggauuggauugcgaaccacgaacuggcuuagauuuuucagaucuauacuauuuaacaaugaauaacaaacauuggcuaguacauaaagaaugguuccacgauauaccauuaccauggcaugcuggggcagauacuggaacaccacauuggaauaauaaggaagcauuaguagaauuuaaagaugcucacgcaaaaagacaaacaguagucguguuaggaagucaagaaggagcaguacauaccgcauuagcuggugcacuagaagcagaaauggauggagcaaaaggaagauuauuuucuggacaucuaaaaugccgauuaaagauggauaaacuuagauuaaaagguguuagcuacagucuauguacagcagcauucacauucaccaaaguaccugcagagacccuacacggaacaguuaccguagaaguacaauaugcagggacugauggaccaugcaaaguaccugcacaaauggcaguagacaugcaaacauuaaccccaguaggaagauuaauaacagcuaauccaguaauaacagaaucaacagaaaacagcaaaaugaugcuagaauuggacccaccuuuuggagauaguuacauaguaauaggaguaggagauaagaaaauaacacaucacuggcauaggagugguaguacaauuggaaaagcauuugaagcaacaguuagaggagcuaaaagaauggcagucuuaggagauacagcaugggauuuuggaaguguaggagguguuuuuaauucguuaggaaaaggaauacaucaaauauuuggagccgcuuucaaaagucuuuuuggaggaaugucaugguuuucacaaauucuuauagggacauuauuaguuuggcuuggauuaaacacuaaaaacggaaguauaucuuuaacaugccuagcacuaggagggguaaugauuuuucuaaguacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4850 - RNA, 2272 nt, Artificial Sequence
  KU963573.2 prME-short mRNA Design 1 opt
gggagaaagcuuaccaugacgucaauugguauaauaggccuauuacuaacaacagcuauggcggcagaaauuacaagaaggggaucagcauauuauauguaccuagauagaucagaugcagguaaagcuauaaguuuugcuacuacauugggaguaaauaaaugucacguacaaauaauggaucugggucauaugugcgacgcuacaaugucguaugaauguccaaugcuagacgaaggggucgaaccugaugauguagauuguugguguaauacuacaucgacauggguaguauauggcaccugucaucacaaaaaaggagaagcaagaagaucaagaagggcaguaacacuaccaagucauagcacuagaaaauuacaaacaagaagccaaacaugguuagaaagccgagaauauacaaaacauuuaauaaaaguagagaauuggauauuuagaaauccaggauuugccuuaguagcaguugcaauagcauggcuacuuggaucauccacuagucaaaaaguaauauaucuaguaaugauauuauuaauagcaccagcauauaguauuagauguauaggaguuucaaauagagacuuuguugaagguaugucuggaggaacauggguagacguagucuuagaacauggaggauguguaacaguaauggcacaagauaaaccuacaguagauauagaacuaguaacaacaaccguuaguaauauggcagaaguaaggucauauuguuacgaagcaucaauaucugacauggcaagugauagucgaugcccaacacaaggugaagcguauuuggauaaacaaucagauacacaauauguauguaaaagaacucuaguagauagagguuggggcaacggcuguggauuauuuggaaagggaagccuaguaacaugugcaaaauucacuugcaguaaaaaaaugacaggaaaaucaauacaacccgagaaccuagaauauagaauaauguuaucaguacaugggucgcagcacucaggaaugauaggauaugaaacagaugaaaauagggcuaaaguugagguuacgccaaauucuccacgcgcagaagcaacauuagguggauucggcucacuaggacuagauugugagccaagaacaggauuagacuuuagugaucuauauuaucuaacaaugaauaauaaacauugguuaguacauaaagaaugguuucaugacauaccauuaccauggcacgcaggagcugauacaggcacuccgcauuggaauaauaaagaagcacucguagaguuuaaagacgcacacgccaaacgacaaacagugguuguacuaggaucacaagaaggagcaguucacacagcacuagcaggagcacuagaagccgaaauggauggagcuaaagguaaauuauuuaguggacaucugaaaugcagacuaaaaauggacaaacuuagauugaaagguguaaguuauaguuuaugcaccgcagccuuuacuuuuacaaaaguaccagcagaaacacuucauggcacaguaacaguugaaguacaauaugcugguacagauggaccuuguaaaauuccuguacaaauggcagucgacaugcaaacauuaacaccaguuggacgccuaauaacggcuaauccaguaauaacugaaagcacagagaauaguaaaaugauguuagaauuagaucccccauucggagauaguuacauuguaaucggaguuggagauaaaaaaauaacgcaucauuggcacagaagcgguucaacaauaggaaaagcauuugaagcaacagucagaggugcgaaaagaauggcaguccucggcgauacagcaugggauuucgguucagugggaggaguauucaauucucuagggaaagguauacaucaaauauuuggugcagccuuuaaaucauuauuuggaggaaugaguugguuuucccaaauauuaauuggaacauuauuagugugguuagggcucaacacaaaaaacggaaguauaucacuaacuuguuuagcacuaggaggaguaaugauauuuuugucaacugcuguaagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4851 - RNA, 2284 nt, Artificial Sequence
  KX694534.2 prME-short mRNA Design 1 opt
gggagaaagcuuaccaugacaagcguaggaauaguaggucuauuacuaacgacagcaauggcagcagaaguaacuagaagaggaucggcauauuauauguauuuagacagaaaugaugcgggggaagcaauaucuuuuccgacaacauuaggaaugaauaaauguuauauacaaaucauggaccuuggacauaugugugacgcgacaaugucauaugaauguccaauguuggaugaaggaguagaaccagaugauguugauuguugguguaacacgacaucuacauggguaguauauggcacuugccaucauaaaaaaggagaagcgagaagaagcagaagagcagugacacuaccuagucauucaacaagaaaauuacaaacaagaucacaaacaugguuagaaucaagagaauacacaaaacacuuaauucgaguugaaaacuggauauucagaaacccaggauuugccuuagcugcugcagcaauagcaugguuauuaggcaguaguacaagccaaaaaguaauauaucuaguaaugauccuauuaauagccccagcauauaguauaagauguauugguguaucuaaucgagauuuuguagaaggaaugucaggaggaacauggguagacguaguauuagaacacggaggaugugucacaguaauggcacaagacaaaccaacaguagauauugaauuagucacaacuacaguaagcaauauggcagaaguaagaaguuauuguuaugaagccuccauaucagauauggcaagugacucaagauguccgacucaaggagaagcuuaucuugauaaacaaagcgauacucaguacguaugcaaaagaacacuuguugauagaggcuggggaaacggaugcggauuauucggaaaaggaagccugguaacaugcgcuaaauuugcauguaguaaaaaaaugacaggaaaaagcauacaaccagaaaaucuagaauaucgaauaauguuaucaguacacggcucacagcauucaggaaugauuguuaacgacacaggacacgaaacugacgagaauagagcaaaaguugaaauaacaccaaacucaccgagagcagaagcaacauuaggaggcuucggcagccuaggacuagacugugaaccacgaacaggcuuagacuuuagugaucuauauuaccucacuaugaauaacaaacauugguuaguucacaaagaaugguuccaugauauaccuuuaccauggcaugcaggugccgauacugguacaccacacuggaacaacaaagaagcauuaguagaauuuaaagaugcacaugcaaaaagacaaacaguuguuguauuaggaucacaagaaggagcaguacacacagcguuagcaggggcacuagaagcagaaauggacggggccaaaggacggcuaaguucaggacauuuaaaauguagauuaaaaauggauaaauuaagacuaaaaggaguaucguacucgcugugcacagcagccuuuacauucacaaaaauuccugccgaaacacuacacggaacuguaacaguagagguacaauacgcagguacugauggaccauguaaaguaccagcgcaaauggcaguagauaugcaaacauugacaccaguaggaagauuaauaacagcaaauccaguaauaacagaaucuacagaaaacucaaaaaugaugcuugaauuagauccaccuuuuggagauaguuacauaguaauagggguaggagaaaaaaagauaacccaccauuggcauagaucaggaucaaccauagggaaagcauuugaagccacugucagaggagcuaaaaggauggcaguuuuaggagacacagcaugggauuucggaagcguggguggcgcacucaauagucuuggacgaggaauacaucaaauauuuggugccgcauucaaaagucuuuuuggaggaaugaguugguuuucucagauacuaauuggaacauuauuaauguggcuaggauuaaauacaaaaaauggaaguauuucauugauguguuuagcacuaggaggaguauuaauauuucuaaguacggcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4852 - RNA, 2284 nt, Artificial Sequence
  KX369547.1 prME-short mRNA Design 1 opt
gggagaaagcuuaccaugacaagugucggaauagugggauuacuuuuaacaacagcaauggcugcugaaguaacuagaagagguucagcauacuacauguacuuagacagaaaugaugcaggagaagcaauaaguuuuccgacaacauugggaaugaauaaauguuauauacaaauaauggauuuaggacauaugugugaugcaacaaugucauaugaaugucccauguuagacgaaggcguagaaccagaugauguggauugcuggugcaauacaacaucaacuuggguagucuacggaacaugucaucacaagaaaggugaagcaagaagaagcagacgagcaguaacauuaccuagucauagcacuagaaaguuacaaacacggagucaaacuugguuagagaguagggaauauacaaagcauuuaauaagaguagaaaacuggauauucagaaauccaggucuagcucuagcugcagcugcaauugcauggcuauuaggaucaaguaccucacaaaaagugauauauuuaguaaugauuuuacuaaucgcaccagcauauucaauaagaugcauaggaguuagcaaucgagauuucguagaaggaaugaguggaggaacauggguagauguuguauuagaacacgguggauguguuacagugauggcgcaagauaaaccuacaguagauauagaauuaguuacaacaacuguuagcaauauggcggaaguaagaaguuauuguuacgaagccaguauaagugauauggcaucggacaguagaugccccacacaaggugaagcauaucuagauaaacaaucagauacacaauauguuugcaaaagaacauuaguagacagagguuggggaaaugguugcggucuuuuuggaaaagguagucuaguaacaugcgcaaaauucgccuguagcaagaaaaugacagguaaaaguauacagccugaaaacuuagaguauagaauaaugcuaucaguacacgggagccaacacagcggaaugauuguuaacgacacgggacaugaaacagaugaaaacagagcaaaaguagaaauuacaccgaauagcccucgagcagaagccacacuaggugguuuuggaagccuaggauuggacugugaaccaaggacaggucuagauuuuagugaucuauauuacuuaacaaugaacaauaaacauugguuaguacauaaagaaugguuucaugacaucccuuuaccauggcaugcaggagcagauaccggaacuccacauuggaacaauaaagaagcauuaguagaauuuaaagaugcacacgcaaagagacaaacaguaguaguauuaggaagccaagaaggagccguacauacagccuuagcaggcgcguuagaagcagaaauggauggagcaaaggguagauuaaguucgggacauuugaaauguaggcucaaaauggauaaauuacgauugaaaggaguaaguuacucuuuguguacagcagcuuuuacuuuuacaaaaauaccagcagaaacauuacaugguacagucacuguggaaguacaauaugcaggaacagauggaccaugcaaaguaccugcacaaauggcaguagacaugcaaacacuuacaccgguagguagauuaauaacagcuaauccaguaauaaccgaaaguacagaaaacagcaaaaugauguuagaauuagacccgccauuuggagauucauauauaguaauuggaguaggagaaaagaaaauaacacaccauuggcauagaucaggaaguacuauagguaaagcguucgaagcuacaguaagaggagcaaaaagaauggccguguugggcgacacugcaugggacuuuggaucgguuggaggugcacuaaauucauuagguaaaggcauucaccaaauauuuggagcagcauuuaagucauuauuuggaggaaugagcugguuuucacaaauacuaauuggaacguuauuaauguggcuaggauuaaauacuaaaaaugguagcauuaguuuaaugugucuagccuugggaggaguguuaaucuuccuuaguacagcaguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4853 - RNA, 2284 nt, Artificial Sequence
  KX447515.1 prME-short mRNA Design 1 opt
gggagaaagcuuaccaugacaucaguagguaucguaggauuacuauuaacaacagcaauggcagcagaaguuacgagaagagguucagccuacuauauguaucuugauaggaacgaugcaggggaagcuaucaguuuuccuacaacauuaggaaugaacaaaugcuauauucaaauaauggauuuaggacauaugugugacgcuacuaugagcuaugaauguccuaugcuagacgaaggcguagaaccugaugacguagacuguugguguaauacaacaucgaccuggguaguguauggaacgugucaucauaagaaaggagaagcaagaagaagcagacgagcuguaacauuaccaucacauaguacaagaaaauuacaaacacgaucacaaacauggcuagaaaguagagaauauacaaaacauuuaauuagaguugaaaauuggauauuuaggaauccagguuuugcauuggcagcagcugcaauugcguggcugcucggcaguucaacaucacaaaaaguaauauaucuaguaaugauauugcuaauagcuccagcuuauucaauaagaugcauaggaguuucaaauagagacuuuguugaaggcaugaguggaggcacauggguagacguaguauuagaacacggaggaugcgugacuguaauggcacaagauaaaccaacaguagauauugaguugguaacaacaacagugucaaauauggcagaaguaagaaguuauuguuacgaagcuagcauaagugauauggcaucagacagcagauguccuacucaaggcgaagcauaucucgacaaacaaagugauacacaauacguauguaaaaggacacuggucgacagaggguggggaaacggcugugguuuguuuggaaaaggaagucuaguaaccugugcaaaauuugcuuguaguaaaaagaugacgggaaagaguauccaaccagaaaacuuggaauauagaauaauguuauccgugcacgggagucaacauucaggaaugauaguaaacgauacaggacaugaaacagacgaaaauagagcaaaaguggaaauuacuccaaauaguccaagggccgaagcuacucuuggcggauuuggaucauuaggauuagacugcgaaccgaggacaggacuagauuucagugauuuguacuaucuaacaaugaacaacaaacauugguuaguccauaaagaaugguuccaugauauuccauuaccguggcaugcuggugcggauacuggaacaccacauuggaauaauaaagaagcauuaguagaauuuaaagaugcucaugcaaaaagacaaaccguaguaguuuuagguagucaagaaggagcaguacacacagcauuggcgggagcccuagaagcagaaauggauggagcaaaagggagacuaucuucaggacacuugaaauguagauugaaaauggauaaacucagauuaaaagggguaucauauucauuauguacagcugcauucacauuuacaaaaauaccagcugaaacacuacaugguacuguuacgguagaaguacaauaugcaggcacagacggaccuuguaaaguuccagcacaaauggcaguagacaugcaaacauuaacaccuguaggaagauuaauaacagcaaauccagugauaacagaaucaacagaaaauaguaaaaugauguuagaauuagauccaccauuuggcgauucauauauaguaauagguguaggagaaaagaaaaucacccaccauugguauagaagcggaagcacaauagguaaagcauuugaagcaacaguaagaggagcaaaaaggauggccguucuaggagacacugcaugggauuuuggaaguguaggaggagcacuaaacucuuuaggaaaagguauucaucaaauauuuggagcagcauuuaaaucguuauucggaggaaugagcugguuuucacaaaucuuaauaggaacauuacuaauguggcuuggauugaauaccaaaaauggaucgauaucuuuaaugugucuagcacuagggggaguuuuaauauuucuaucaacagcagugagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4854 - RNA, 2284 nt, Artificial Sequence
  KU729218.1 prME-short mRNA Design 1 opt
gggagaaagcuuaccaugacgucuguuggaauaguuggauuauuacuaacaacagcaauggcagcagaaguuacaagaagaggcucagccuauuacauguacuuagauagaaaugacgcaggagaagcuauuagcuuuccgacuacucuaggaaugaauaaaugcuacauacaaauaauggacuuaggacacaugugcgaugcaacaaugaguuacgaauguccaaugcuagacgaggguguugaaccggaugauguagauuguugguguaacaccacaagcacuugggugguauauggaacgugucaccacaaaaaaggagaagcacguagaucacgaagggcaguaacacucccaucacauaguacuagaaaauuacaaacaagaagucaaacgugguuagaaucaagagaauacaccaaacacuuaauuagaguagaaaauuggauauuucgaaauccagguuuugcucuagcagcagcagcaauagcaugguuauuaggaagcucgacaagucaaaaaguaauauauuuaguaaugauacuauuaauagcuccggcuuauucaauaagauguauaggaguaucaaauagagacuuuguagaaggaaugucuggaggaacuuggguugaugugguauuagaacaugggggauguguaacaguaauggcccaagauaaaccaacaguugauauagaacuuguuacaacaaccguaaguaacauggccgaaguaagauccuauugcuaugaagcaucaauaucggauauggcaagugauucaagauguccuacucaaggagaagccuacuuagacaaacaaagcgauacacaauauguaugcaaaaggacacuaguagaucgugguuggggaaacggauguggauuguucggaaaagguagccucguaacaugugcaaaauuugcuuguaguaaaaaaaugacaggaaaaucaauacaacccgaaaauuuagaauauagaauaaugcuaaguguccacgggagccaacauagcgguaugauaguuaacgauacaggacaugaaacugaugaaaauagggcaaaagucgaaauaacaccaaauaguccaagagcagaagcaacauuagguggauuuggaucuuuaggacuagacugugaaccaaggacugguuuagauuuuagcgacuuauauuaucuaacaaugaacaauaaacauugguuaguacauaaagaaugguuccaugauauaccauuaccauggcacgcaggagcagauaccgguaccccgcacuggaauaauaaagaagcacuaguugaauuuaaagacgcacaugcaaaacgucagacaguaguaguauuaggaagucaagaaggcgcaguacauacagcauuagcaggagcacuugaagcggaaauggauggugcaaaaggaagauuaaguucaggacauuugaagugucgguuaaaaauggacaaacuaagauuaaaaggaguaucauauucgcuauguacagcugcuuuuacauucacuaaaaucccagcugaaacacuacauggaacaguaacaguagaaguucaauaugcagguacugacggaccaugcaaagucccagcacaaauggcaguggauacacagaccuuaacacccgugggaagacuuauuacugcaaauccaguaauaacugaaucaacugaaaauucaaaaaugauguuagaauuagauccaccauuuggagacucguauaucguaauugguguaggagaaaaaaaaauaacucaucacuggcauagaucaggaucaacaauaggaaaagcauucgaagcuacaguaagaggcgcaaaaagaauggcaguccuaggagauacugcaugggacuucggaagcguaggaggcgcacuuaauucucuagguaaaggaauacaucaaauauuuggagcagcauuuaaaagcuuauuuggaggaauguccugguuuucacaaauacuaauaggaacuuuguuaauguggcuuggucuuaauacaaaaaaugggucaauaaguuuaaugugccuagcuuuaggaggggucuuaauauuucuuuccacugcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4855 - RNA, 2284 nt, Artificial Sequence
  KU501217.1 prME-short mRNA Design 1 opt
gggagaaagcuuaccaugacaucaguuggcauuguaggauuacuauuaacaacagcuauggcagcagaaguaacacgaaggggaucagcauauuauauguaucuagauagaaacgaugcaggagaagcaaucagcuucccaacaacacuagggaugaauaaauguuauauacaaauuauggauuugggccacaugugugacgcaacaaugaguuaugaaugcccaaugcuugacgaaggaguugaacccgaugauguagacugcugguguaauacaaccucaacuuggguaguuuauggaaccugucaucacaagaaaggagaagcucgaagaucaagacgagcaguaacauuaccuagucauucaacgagaaaauuacaaacuagaucacaaacuuggcuugaauccagagaauacacaaaacaucuaauaagaguugaaaacuggaucuuuagaaacccugguuuugccuuagcagcggcugcaauagcaugguuacuaggaucaucaacaagucagaaagucauauauuuagucaugauauuacuaauagcuccugcauacucuauaagauguauaggugugaguaauagagacuuuguggaaggaaugucugguggaacauggguggacguaguuuuagagcacgggggaugcguuacaguaauggcccaagauaaaccaacaguugauauugagcuaguaacaacgaccguaagcaauauggcagaaauaagaucauauugcuaugaagccucaauuagugacauggcuagcgauagcagaugcccaacacagggagaagcauaccuggacaaacaaucagacacacaauauguaugcaaaagaacauuaguagacagaggauggggaaaugguuguggacuauuuggaaaagggucauuaguaacaugcgcaaaauuugcauguucaaagaaaaugaccgguaaaucaauacaaccagaaaauuuagaauacagaauaaugcuaucaguacacgguagucaacauagcgggaugauuguaaacgauacaggacacgaaacagaugaaaaucgcgcaaaaguagaaauaacgccaaauaguccuagagcugaagcaacauuggguggauuugggaguuuaggacuagauugcgaaccuagaacaggacuagauuuuagugacuuauauuaucucacaaugaauaauaaacacugguuaguucacaaagaaugguuucaugauauaccauuaccauggcaugcaggagcagauacagguacaccccauuggaacaauaaagaagcucuaguagaguuuaaagacgcacaugcaaaacgacaaacaguaguaguuuuagguagucaagaaggcgcagugcauacagcacuagcaggagcauuagaagcagaaauggacggugcgaaaggucgauuaaguaguggacauuuaaaaugccgacuaaaaauggacaaauuacgauuaaaagguguaucauacucauuauguaccgcugcauucacuuuuacaaaaauaccugcagaaacauugcacggaacuguaacaguagaaguacaauaugcggguacagauggaccaugcaaaguuccagcccaaauggcuguggauaugcaaacacuaacaccaguagguagacuuauaacggcaaauccaguaauaacagaaaguacagaaaauucaaaaaugauguuagaauuagaucccccauuuggagacagcuauauaguuauaggaguaggagagaaaaagauaacucaucauuggcaucgaagcgguucaacaauuggaaaagcauuugaagcaacuguaagaggagcaaaaagaauggccgucuuaggggacacugcuugggauuucggaucaguaggcggugcauuaaauucacuaggaaaagguauucaccaaauauuuggagcagcauucaaaucauuauucggaggcaugaguugguucagucaaauacuaauaggaacauuacuaauguggcuuggacuaaacacuaaaaaugguucaauaaguuuaaugugucuugcauuaggcggcguacuuauauuuuuaucaacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4856 - RNA, 2284 nt, Artificial Sequence
  KU312314.1 prME-short mRNA Design 1 opt
gggagaaagcuuaccaugaccucaguagguauaguuggauuacuacuaacaaccgcaauggcugcagaaguaacaagaagaggaucagcauauuauauguauuuagacagaaacgaugcaggggaagcgauaucuuuuccaacaacuuuagggaugaauaaauguuacauacaaauaauggaccuaggucacaugugugaugcaacuaugucauaugaaugcccaaugcucgaugaaggaguagaaccagacgacguagacuguugguguaauacaacuucaacauggguaguauauggcacaugccaucauaagaaaggagaagcaagaagaucacguagagcaguaacauugccaucacauucuaccagaaaacuacaaacaagaagccaaacaugguuagaaucaagagaauacacaaaacacuuaauaagaguagaaaauuggauuuuuagaaacccagguuucgcuuuagcugcagcagcuauagcuuggcuauuagggaguagcacaucacaaaaagucauauaucuaguuaugauccuccugauagcaccagcauauaguauacgauguauaggaguaucaaacagggacuucguugaaggaaugaguggaggaacuuggguagauguuguucuagagcauggaggcuguguaacuguaauggcacaagacaaaccaacaguagacauagagcuaguaacaacuacuguaagcaauauggcugaaguaagaucuuauugcuaugaagcaagcauaucagauauggcaagugacagucgauguccaacccaaggagaggcuuauuuagauaaacaauccgauacucaauauguuuguaaacgaacccuaguggacagaggaugggguaacggauguggacuauuugggaaaggaagccucgugacaugugcaaaauuugcuuguucgaaaaagaugacaggaaaaucaauacaaccugaaaaucuagaauauagaauaaugcuaucuguacacggaagccaacauaguggaaugauaguaaaugacacaggucaugaaacagacgagaacagagcaaaaguugaaauuacgcccaauagcccucgagcagaagcuacacuagggggauuugguucucuaggacuagacugugaaccaagaacaggccuagauuuuucagaccuauauuauuuaacaaugaauaauaaacacuggcuaguccauaaagaaugguuccacgauauaccauuacccuggcacgccggagcagacacaggaacaccucacuggaauaauaaagaagcccuuguagaauuuaaagaugcacacgcaaaacgucaaaccguaguaguauuaggcagucaagaaggagcaguucauacagcauuagcuggagcauuagaagcagaaauggacggagcaaagggcagacuauccucaggacaucuaaaaugcagauugaaaauggauaaacuacgauuaaaaggaguaaguuauucacuguguacagcagcauuuacguuuacaaaaauaccagcagaaacauuacacggaacagucacaguagaaguucaauaugcaggaacagacgguccauguaaaguauuagcacaaauggcuguagauaugcaaacacuaacaccuguaggaagauuaauuacugcaaauccuguuaucacugaaagcacagaaaacucaaaaaugaugcuugaauuagauccaccauuuggcgauucauacaucgucauuggaguaggagaaaagaaaauaacgcaucacuggcaccgaaguggaucaacaauagguaaagcauuugaagcaacaguacguggagcuaaaagaauggcaguuuuaggagauacagcuugggauuuuggaagugucgguggagcacuaaacucacuaggaaaaggaauacaucaaauauuuggagcagcauucaaaucauuauuuggaggcaugucaugguuuagucaaauuuuaauaggaacucuacuaaugugguuaggauuaaacacuaaaaacgguucaauauccuuaaugugucuagccuuaggaggaguucuuauauuucucagcacagcuguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4857 - RNA, 2284 nt, Artificial Sequence
  KX446950.2 prME-short mRNA Design 1 opt
gggagaaagcuuaccaugacgaguguaggaauaguaggauuguugcuaacaacagcuauggcugcagaaguaacuagaagaggcagugccuacuacauguacuuagacagaaaugacgcuggugaagcaauuagcuuuccaacaacacuaggaaugaacaaauguuauauacaaauaauggacuuaggccauaugugugaugcaaccaugucauacgaguguccaacauuagacgagggcguugaaccagacgacguagauugcugguguaauaccacuucaacauggguaguauaugguacuugucaccauaagaaaggugaagcaagaagaucacguagagcagugaccuuaccuucacauucuacaagaaaauuacaaacaaggagucaaacauggcuugaaucaagagaguauacaaaacaccuaauaaggguugaaaauuggauauuucgaaacccgggguuugcacuagccgcagcugcaauagcauggcuccuaggaaguucaacuagccaaaaaguaauauaccuaguaaugaucuugcuuauagccccagcauacaguauaagauguauuggagugaguaauagagauuucguagaaggaaugucaggagggacuuggguugauguaguauuagaacauggaggaugcguaaccguaauggcacaagauaaaccgacgguugauauagaauuaguaaccacaacaguaaguaauauggcugagguaagaaguuacuguuaugaggcaucaauaucagacauggccagcgacagucguuguccaacgcaaggagaagccuauuuagacaaacaaucagauacacaauauguauguaaaagaacucuaguugauagaggauggggaaacggcugcggacuuuuuggaaaaggaucauuagugacaugcgcaaaauuugccuguaguaagaaaaugacagguaaaucuauacaaccugaaaauuuagaauauagaauuauguuaucaguacacggaucacaacauucggggaugauaguaaaugauaccggacacgaaacagaugaaaauagagcuaaaguugaaaucacaccaaacaguccaagagcagaagcaacauuaggcggauucggaucacuaggccuagauugugaaccaagaacaggacuagauuuuagcgaucuuuauuacuuaacaaugaauaauaaacauugguuaguucauaaagaaugguuucaugauauaccccuuccauggcaugccggagcagauacuggaacaccacacuggaauaacaaagaagcauuagucgaauuuaaggaugcacaugcaaaaagacaaacuguuguaguauuaggaucacaagaaggagcaguacauacagcuuuagcuggagcacuagaagcugaaauggacggagcaaaaggacgauuaagcucuggacaccuaaaauguagacuaaaaauggauaaacuaagacucaaaggaguuucuuauucguuauguacugcagcauuuacuuuuacaaaaauuccagcagaaacgcuacauggaacaguaacuguagaaguacaauaugccggaacugauggaccauguaaagucccagcacaaauggcaguugauaugcaaacacuaacuccaguaggaagauuaauaaccgcuaauccagucauaacagaaucaacagaaaauucaaaaaugauguuagaauuggauccucccuuuggugacaguuacauaguaauaggaguaggagaaaagaaaauaacacaucacuggcauagaaguggaucaacuauagguaaagcauuugaagcuacaguacgaggagcaaaaagaauggccguucuuggagacacagcuugggacuuuggaaguguaggaggagcucuaaauagcuuaggaaaggguauacaucaaauauuuggagccgcuuuuaaaagucuauucggaggaaugucaugguuuucacaaauauuaauaggaacacuacuaaugugguuaggacuaaauacgaaaaauggcagcauuagcuuaauguguuuagcacuaggaggaguucuaauauucuuaucaacagccguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4858 - RNA, 2284 nt, Artificial Sequence
  KY003157.1 prME-short mRNA Design 1 opt
gggagaaagcuuaccaugacaucaguaggaauagugggauuacuuuuaacaacggcaauggcagcugaaguaacaagaagaggcagugcuuauuauauguauuuagacaggaaugaugcaggugaagcaauuaguuuuccuacaacuuuaggcaugaacaaauguuacauacaaauaauggaucuaggacauaugugcgaugcaacaaugucauaugagugcccuauguuagaugaagguguugaaccagacgauguggauugcugguguaauaccaccagcacuuggguaguauacggaacaugucaucauaaaaaaggcgaagcaagaagaaguaggagagcuguaacucucccuagucauucuacgagaaaauuacaaacaagaucacaaacuuggcuugaaucaagagaauauacaaaacauuuaauacgaguagaaaacuggauauuuagaaauccagguuucgcacuggcagcagcagcaauagcaugguuacuaggaucaucaacaagccaaaaaguaauauacuuaguaaugauucuguuaauagcaccagcguauagcauccguuguauagguguaucaaauagagauuuugucgaaggaaugaguggaggaacauggguugauguaguucuagaacacggaggcugcgucacagucauggcacaagauaaaccaacgguagauauugaauuaguaacaacaaccgucagcaacauggcagaaguaagaucauacuguuaugaagcaucaauauccgauauggcaucagacucuagauguccaacucagggagaggcauauuuagauaaacaaucagauacgcaauauguauguaaaagaacauuaguagauagaggguggggcaauggauguggauuauuuggaaagggaucuuuaguuacuugugcaaaauuugcaugcucaaaaaaaaugacaggaaaaaguauucaaccagaaaauuuagaauaccgaauaaugcuuaguguacacggaagucaacauucaggaaugaucgucaaugacacagggcacgaaacagacgaaaacagagcaaaaguagaaauaacaccuaauucuccaagagcagaagcaacuuuagguggauucggaagcuugggccuugauugugaaccaagaaccgggcuugauuuuagcgauuuauacuauuuaacaaugaauaauaaacauugguuaguacauaaagaaugguuccaugauauaccucuaccauggcacgcaggugcagauacaggaacaccacacuggaacaauaaagaagccuuaguugaauuuaaagaugcacaugcgaaaagacaaacagucgucguacuaggaagucaagaaggagcaguacauacugcucuugcaggggccuuagaagcagagauggauggagcaaaaggaagauuaucuucgggacaucucaaauguagauuaaaaauggauaaauuaagacuaaaaggugucuccuacagucuauguacggcagcauucacauuuacaaaaauaccugcagaaaccuuacauggaacaguaacagucgaaguacaauaugcaggaacagaugguccauguaaaguaccagcacaaauggcaguugauaugcagacauuaacacccguaggaagauuaauaacagcaaauccagucauaacugaaucaacagaaaacaguaaaaugauguuagaauuagauccgccauucggagauaguuauauaguuauuggagucggugaaaaaaaaauaacucaccauuggcacagaucaggaucaacaauaggaaaagcauuugaagcaacaguaagaggagcaaaaagaauggcaguguuaggagauacugcaugggauuuuggaaguguaggaggagccuugaauucauuagguaaagguauacaccaaauauuuggggccgcauuuaaaagcuuauuuggaggaaugaguugguuuucacaaauucuaauaggaacauuauuaauguggcuuggauuaaauacuaaaaacgguucuauuucacuaauguguuuagcauuaggcgggguucuaauauuucuuucuacggucguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4859 - RNA, 2284 nt, Artificial Sequence
  KX811222.1 prME-short mRNA Design 1 opt
gggagaaagcuuaccaugacaucaguugguauaguuggacuacuauuaacaacagcgauggcagcugaaguaacaagaagaggaucagcauauuacauguacuuagauaggaacgaugcuggugaagcaauuucauuuccuacaacacuaggaaugaauaaauguuauauacaaauaauggaccuaggucauaugugcgaugcuacuaugucuuaugaaugcccaaugcuagaugaaggaguagaaccagaugauguagacuguugguguaacacaaccagugcauggguaguauaugguaccugccaucacaagaaaggagaagcuagaagaucuagacgagcuguaacauuaccuagccauucaacgagaaaauuacagacaagaccacaaacuuggcuagaaucuagagaauacaccaaacaucuaauaaggguagaaaauuggauauuuagaaauccagguuuugcacuagcugccgcagcaauugcuugguuacuagguucaucaacaucucaaaaaguaaucuaucuaguuaugaucuuacuaauagcuccugcauauaguauaagaugcauaggaguaagcaacagagauuuuguagaagguaugucagguggaacauggguugauguaguacuugaacacgguggaugugugacuguaauggcacaggauaaacccacaguggacauagaauuaguaacaacaacugugucaaauauggcugaaguaagaucauacugcuaugaagcaucaauuagugauauggcauccgauaguagauguccuacacaaggagaagcauaucuagauaaacaaagugacacacaauaugucuguaaaagaacguuaguugauagaggauggggaaauggaugcggauuauuuggaaaaggaucacuuguaaccugugcaaaauuugcauguucaaagaaaaugacaggcaaaaguauacaaccagaaaaucuagaauauagaauaauguuaucgguccauggaucacaacauagcgguaugauuguaaaugauacaggacacgaaacagacgaaaauagggcaaaaguugaaaucaccccaaacucacccagagcagaagcaacucugggaggauuuggcagccugggauuagauugugaaccaagaacuggacuugauuuuagugaucuauacuaucuuacaaugaacaauaaacauuggcucguacauaaagaaugguuccaugauauaccauuaccuuggcaugcaggagccgauacaggaacaccacacuggaacaauaaagaagcauuaguagaguucaaagacgcacaugcaaaaaggcaaacaguaguuguacuaggaagccaagaaggagcaguucauacugcauuagcgggugcauuagaagccgaaauggauggagcgaaagguagauuaucuucuggacacuugaaaugucgcuuaaaaauggauaaacuaagacuaaaaggaguaaguuacucauuaugcacagcagcauucacauuuacaaaaauuccugcggaaacacuacacggaacuguaacaguagaaguacaauaugcuggaacugauggaccauguaaaguucccgcacaaauggcaguugacaugcaaacauuaacaccgguaggaagauugauuacugcgaacccuguuauaacagaaaguacggaaaauaguaaaaugaugcuagaauuagauccaccuuuuggagauaguuauauaguaauaggaguaggugaaaagaaaauaacacaucauuggcacagaagcggaucaacaauaggaaaagcauuugaagcuacaguuagaggagcuaaacgaauggccguacuuggagacacagccugggauuuuggcuccguaggaggagcauuaaacagucuagguaaaggcauacaucaaauauuuggagcagccuuuaaaaguuuauuuggagguaugucaugguuuucacaaauacuaauaggaacauuauuaauguggcuaggacuaaacacuaaaaauggaucgauaagccuuaugugcuuagcacuaggagguguuuuaauauuucuaagcacagcagugucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4860 - RNA, 2284 nt, Artificial Sequence
  KX447516.1 prME-short mRNA Design 1 opt
gggagaaagcuuaccaugacaucugugggaauaguagguuuauuauuaacuaccgcaauggcugccgaaguaacaagaagaggaucagcauauuauauguaccuugauagaaaugaugcaggagaagcaauaucuuuuccaacaacauuagguaugaauaaaugcuacauacaaauuauggauuuaggacauaugugugaugcaacgaugucauaugaauguccaaugcuugaugaaggaguugaaccugacgauguagauuguugguguaauacaacaagcaccuggguuguauauggaacaugucaucauaaaaaaggagaagcucgaagaaguagaagagcaguaacccuaccgagccacagcacuagaaaauuacaaacuaggucacaaaccuggcuagaaaguagagaauacacaaaacaucuuauaagaguagaaaauuggaucuuuagaaauccagguuucgcacuagcagcagcagcaauagcauggcuacuagguucguccacaucaaaaaaaguaauauauuuaguaaugauauuacuaauagcaccagcauauucaauaagauguauagguguaaguaauagagauuucguugaaggaaugaguggaggaacauggguagauguagucuuagaacacggaggaugugugacuguuauggcacaagacaaaccaacaguagacauagaacuuguaacgacaacaguaagcaauauggcagaaguacguaguuauugcuaugaagcaucaauuucagauauggcaucagauuccagauguccaacacaaggagaagcuuauuuagauaaacagucagauacgcaauauguuugcaaacgaacccuaguugacagaggguggggcaacggaugcggauuguucggaaaaggaucguuaguaacuugugccaaauucgcauguucuaaaaaaaugaccggaaaaucaauacaaccagaaaauuuagaauauagaaucaugcuaagcgugcauggcucacaacacucuggcaugauuguaaaugauacaggacaugaaacugacgagaauagagcuaaaguagaaauaacaccgaauucacccagagcagaagcaacauuaggaggauucggaucacugggauuagauugcgaaccacgaacaggauuagauuucagugaccuuuauuauuuaacaaugaauaauaaacauugguuaguacauaaagaaugguuccacgacauaccauuaccuuggcaugcaggcgccgauacaggaacaccacauuggaauaauaaagaagcucuaguagaauuuaaagaugcacaugcaaaaaggcaaacaguagucguucuaggaucacaagaaggagcaguacauacagcauuagcaggagccuuagaagccgaaauggauggcgcaaaaggaagacuaagcagcggacauuugaaaugucgguuaaagauggacaaguuaagguuaaaaggcguuagcuacaguuuauguacagcagcauuuaccuucacaaaaaucccugccgaaacauuacauggaacaguuacaguagaaguucaauaugccgggacugacggaccauguaaaguaccagcucaaauggcaguagacaugcaaacauuaacaccuguuggaagacuaauaacagcaaauccagugauaacugagaguacagaaaacaguaaaaugauguuagaauuggacccuccauucggugacagcuauaucguaauaggaguaggugaaaaaaaaauaacacaucacuggcacagaucaggaucaacaauagguaaagcauucgaagcaacaguacguggagcaaaacgaauggcgguucuaggagauacugcgugggauuucggaagcgucggaggggcauuaaacucauuagggaaaggaauucaucaaauauuuggugccgcauuuaaaagccuauuuggagguaugaguugguuuagucaaauauuaauuggaacacuccuuauguggcucggauuaaauacuaaaaacggaucuauuaguuuaauguguuuggcauuaggugguguacuuauauuuuuaaguacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4861 - RNA, 2284 nt, Artificial Sequence
  KX520666.1 prME-short mRNA Design 1 opt
gggagaaagcuuaccaugacgaguguagguauaguaggauuauuacuaaccacagcuauggccgcagaaguaaccagaagaggaagugcauacuauauguacuuagaucggaaugaugcaggggaagccauaagcuuuccaacaacucuagguaugaauaaaugcuauauacaaauaauggacuuaggacauaugugugaugcgacaaugagcuaugaauguccaaugcuagacgaaggcguagaaccagaugauguugacugcugguguaacacaacaaguacauggguaguauacgggacaugucaccauaaaaaaggcgaagcgcgaagaucaagaagagcaguuacauuaccaagucauuccacuagaaaauuacaaacccguucacaaacauggcuugaaucacgagaauacacaaaacaucuuauucguguagaaaacuggauauuccgaaauccgggauuugcacuagcagcagcagcaaucgcaugguuauuaggaaguucuacaagacaaaaaguuauauaccucguaaugauacuuuuaauagcaccagccuauagcauaagauguauaggaguauccaacagagauuucguugaaggaaugaguggaggaacauggguagacguagucuuagaacauggaggauguguaacaguaauggcucaagauaaaccuacaguugauauagaacucguaacaacuacaguaaguaauauggccgaaguccguucauauuguuaugaagcaucaauaucagauauggcgagcgacaguagauguccuacccaaggagaagcauauuuagacaaacaaagugauacacaauaugucugcaaaagaacauuaguggacagagguugggguaauggaugcggacuauucggaaaaggaaguuuaguaacaugugccaaauuugccuguucaaagaaaaugacaggaaaaucaauacaaccagaaaacuuagaauauagaauuauguuaucaguccauggcucacaacacagugggaugauagucaacgacacaggacaugaaacagaugaaaauagagcuaaaguagaaauuacaccaaauucaccccgagcggaagcaacacuaggaggauuuggaucacuaggauuagauugugaaccuagaacagguuuagacuuuagugauuuauacuaucuuacaaugaacaauaaacacugguuaguacacaaagagugguuccaugacauaccacuuccauggcaugcaggagcagacacggggacgccacauuggaauaauaaagaagcauuaguagaauuuaaagaugcacaugcgaaaagacaaacgguaguaguacuagguagccaagaaggagcaguacacacagccuuagcaggugcauuagaagcagaaauggacggagcuaaaggacgguuaucaagugggcacuuaaaaugcagacuaaaaauggacaaauuaagauuaaaaggaguaagcuacucauuaugcacagcagcauuuacauucacuaaaauccccgcagagacuuuacauggcacagugaccguagaaguacaauacgcaggcacagauggaccauguaaaguuccugcacaaauggcuguagauaugcaaacguuaacaccaguugguagauuaauaacugcaaauccuguaauuaccgaguccacggaaaauucaaaaaugaugcuagaauuagacccaccauuuggagauucuuauauaguaauaggagucggagagaagaaaauaacucaucauuggcauagaagcggaaguacaauaggaaaagcauuugaagcaacagucagaggagccaaaagaauggcaguucuaggagacaccgcuugggauuuuggaucaguaggaggugccuuaaauucucuaggaaaaggaauacaucagauauuuggugcagcauuuaaaaguuuauucgguggaaugucgugguuuucacagaucuuaauaggaacgcugcuaauguggcuaggacuaaauacaaaaaauggaucaauaucauuaaugugucuagcauuagguggcguacuaauauuuuuaucaacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4862 - RNA, 2284 nt, Artificial Sequence
  KU497555.1 prME-short mRNA Design 1 opt
gggagaaagcuuaccaugacaagugucggcauaguaggucucuuacugacaacagcgauggcagcagaaguaacaagaagaggcagugcauacuacauguauuuagauaggaaugaugccggggaagcaauaucauucccaacaacuuuagguaugaauaaauguuauauacaaauaauggauuuggggcauaugugugacgcuaccaugaguuacgaauguccaaugcuugaugaaggugucgaaccagaugauguagauuguugguguaauacaacuaguacauggguaguuuauggaacuugucaucacaaaaaaggagaagcgagaagaagcagaagagcugugacacuccccucccauaguacuagaaaacuacaaacacgaagccaaacaugguuagaaucaagagaauauacaaaacauuuaauaagaguagaaaauuggauuuuuagaaauccaggauuugcauuagcugcagcugcaauagcauggcuccuggguucaucaacuagucagaaagugauuuauuuaguuaugauacuacuaaucgcacccgcguauucaauaagguguauagguguauccaacagagauuucguagaaggaaugucuggaggaacauggguugauguaguuuuagaacacgguggguguguuacaguaauggcucaagacaaaccaacuguagauauugaacuaguaacaacuacuguaagcaauauggcagaagucagaaguuauuguuacgaagccucaauaagcgacauggcuucagauucuagauguccaacacaaggggaagcauauuuagauaaacaaucagauacacaauaugucugcaaaagaacacuagucgacagaggaugggggaacgguugcggguuauucggcaaaggaucauuaguuaccugcgcaaaauucgcauguagcaaaaaaaugacggguaaaaguauacaaccagaaaaucuugaauauagaauaaugcuaucuguucacgguucacaacauaguggaaugauagucaaugauacaggacaugaaaccgaugaaaacagagcaaaaguugaaaucacaccaaauucaccucgagcagaggcuacauuaggaggcuuugguagucuuggauuagacugugaaccgagaacaggauuagauuuuagugauuuauauuauuuaacaaugaauaauaaacauuggcugguacacaaagaaugguuucaugauauuccacuuccauggcacgcaggugcagauacagguacaccgcacuggaauaacaaagaagcauuagucgaauuuaaagacgcacaugcaaaaagacaaacaguaguuguuuuaggcacucaagaaggugcaguccauacggcacuagcgggggcacuagaagcagaaauggauggugcuaaaggaagacuaaguucaggacauuuaaaauguagauuaaaaauggauaaauuaagacuaaaaggaguaucauauucauuauguacagcagcauuuacauuuacgaaaauuccagccgaaacccuacacgguacuguuacuguagaaguccaauaugcagguacagauggaccauguaaaguaccugcgcaaauggcaguagauaugcaaacacuuacaccaguaggaagauuaauaacugcgaauccaguaauaacggaauccacagaaaauucaaagaugauguuagaauuagauccaccuuuuggagauucauacauaguaaucggaguuggugaaaaaaaaauaacacaucauuggcauagaucaggcucaacaauaggaaaagccuuugaggcaacaguaagaggcgccaaaagaauggcaguccuaggugacacagcaugggauuuuggaucuguaggaggagcauuaaauucccuaggaaaaggaauacaccaaauuuuuggagccgcuuuuaaauccuuauuuggaggaaugucaugguuuucacaaauucuaauuggaacacuauugaugugguuaggcuuaaacacaaaaaacggaagcaucaguuuaaugugucuggcacucggaggaguacuaauauuccuaucaacagcaguuagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4863 - RNA, 2284 nt, Artificial Sequence
  KY075939.1 prME-short mRNA Design 1 opt
gggagaaagcuuaccaugacuucuguaggaauaguaggccuauuguuaacaacugccauggccgcagaagucacaagaaggggcagcgcauacuauauguauuuagauagaaacgaugcaggagaggcaauuucauuuccaacaacacuaggaaugaauaaauguuauauacaaauaauggaucuuggucauaugugugacgcaacaaugucguaugaauguccuaugcuugacgaagguguugaaccagaugauguagauuguuggugcaauacaacaucaacuuggguaguauacggaaccugucaucauaaaaaaggagaggcaagaagaucaagaagagcaguuacgcuaccuagucauucgacaaggaaauuacaaacaagaagucaaacauggcuagaaagcagagaauacacuaaacaccuaauaagaguagaaaacuggauauuuagaaauccuggauuugcacuagcagcugcggcaauagcauggcuauugggcucaucaacaagccaaaaaguaauauaucuagucaugauacucuuaauagcaccagcauacagcuuaagauguauaggagucagcaaucgagauuuuguagaggguaugaguggagguacauggguggauguaguucuugaacauggaggguguguaacaguaauggcucaagauaaaccaacaguagauauagaguugguaacgacaacagucagcaauauggcagaaguaagaagcuacuguuacgaagcaucaauaucagauauggcaagugacucaagauguccaacacaaggagaagcauauuuagauaaacaauccgauacucaauauguauguaaacgaacguuaguagacagagguuggggaaauggauguggccuuuuuggaaaagguucacuaguaacuugugccaaauuugcauguucaaaaaaaaugacaggaaaaucaauacaaccagaaaauuuagaauauagaaucaugcuuucaguccauggaagucagcacucaggaaugaucgucaaugauacaggacaugaaacugaugaaaauagagcuaaaguugaaauuacaccgaauuccccaagggcugaagcaacucuuggcggauuugguagucugggucuagacugcgaaccaagaacagguuuagacuuuucagauuuauacuaccuaacaaugaauaauaaacauugguuagugcauaaagaaugguuucacgauauuccauuaccauggcacgcaggugcagauacagguacaccacauuggaauaauaaagaggcacuaguagaauuuaaagaugcacacgcaaaaagacaaacaguaguaguauuagguucacaagaaggagcaguacauacagcuuuagcaggagcauuagaagccgaaauggacggcgccaaaggaagacuuucaagcgggcauuuaaaaugcagauuaaaaauggauaaacuuaggcuaaaaggaguaaguuauaguuuauguacagccgcuuucacauuuacuaaaauaccagcagaaacacuacacgguacaguuacuguugaaguucaauacgcagguacagauggucccuguaaaguaccagcacaaauggcuguagacaugcaaacgcuuaccccaguaggaagauuaauuacugcaaacccaguaauaacagaaucaacagagaacagcaaaaugauguuagaauuagauccaccuuucggugauucauauauaguaauaggaguaggagaaaaaaaaauaacacaucauuggcauagaagugggaguacaauugguaaagcguucgaagcuacuguuagaggagcaaaacgaauggcgguauuaggagauacagccugggauuucggaaguguugguggagcauuaaauaguuuaggcaaaggaauacaucaaauauucggagcugcauuuaagagucuauucggugguaugaguugguucucacaaauacuaauuggaacacuauuaaugugguuaggauuaaauacaaaaaacggaaguauaucacuaauguguuuagcauuagguggaguuuuaauuuuucuaagcacagcaguaucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4864 - RNA, 2284 nt, Artificial Sequence
  KY075932.1 prME-short mRNA Design 1 opt
gggagaaagcuuaccaugacgaguguuggcauuguaggguuauuauuaacaacggcuauggcagcagaaguaacaagaagaggaucagcauauuauauguauuuagauagaaacgacgcaggagaagcaauaucuuucccaacaacacuagguaugaauaaauguuauauacaaauaauggaucuaggucauaugugugaugcuacaaugagcuaugaaugcccaaugcuagaugaaggaguagaaccggaugacguagacuguugguguaauacaacaucuacauggguaguauacggaacaugucaccauaagaaaggagaagcaagaagaucgcguagagcagucacacuccccucacauucaaccagaaaauuacaaacuagaagucaaacuugguuagaaucaagagaauauacuaaacacuuaauaagaauagaaaacuggauauucagaaauccaggauuugcauuagcugcggcagcuauagcauggcucuuaggaucuucuaccagucaaaaaguaauauaccuaguaaugauacucuuaauagcaccagcauauucuauacgaugcauuggagugaguaacagagauuuuguugaaggaaugucaggaggaacauggguagacguuguucucgaacacggaggauguguaaccgugauggcucaggauaaaccaacaguagauauugaauuaguaacaacaacaguuucaaauauggcagaaguccgaaguuacuguuacgaagcauccauaucagacauggcaucggauucaagauguccaacccaaggagaagccuauuuagauaaacagucagacacucaauauguuuguaaacgaaccuuaguagaucgaggcugggguaauggauguggacuuuucgguaaaggcagucuuguaaccugcgcaaaauucgcauguaguaagaaaaugacaggaaaaaguauccaaccagaaaaccuggaauauagaauuaugcuaucaguccacggaucacaacauucaggaaugauaguaaaugauacuggucaugaaacagaugaaaauagggcaaaaguagaaauaacuccaaauucaccacgagccgaggccacccuuggaggauuuggaucauuaggccuagauugcgaaccuagaacaggauuagauuuuagugauuuauacuauuuaaccaugaacaacaaacauugguuaguucauaaagaaugguuucaugauauaccauuaccauggcaugcuggagcagauacagguacaccacauuggaacaauaaagaagcauuaguugaauuuaaagaugcacacgcuaaacgucaaacuguuguuguuuuaggaucacaggaaggagcuguacauacagcauuagcgggugccuuagaagcagaaauggacggagcaaaaggucgacuaaguaguggucacuuaaaauguagauuaaaaauggacaaauuaagauuaaaagguguuuccuauuccuuauguacagcagcguuuaccuucaccaaaauaccagcagaaacccuacacggaacaguaacaguagaaguacaauaugcagguacagauggacccuguaaaguuccugcacaaauggcaguagacaugcaaacuuuaaccccaguaggaagauuaauaacagccaauccagugauuacagaauccacagaaaacucgaaaaugauguuagaauuggauccaccauucggugauaguuacauaguuauaggaguaggagaaaagaaaauuacacaccauuggcacagaagcggaagcacaauaggaaaagcauucgaagcaacaguaagaggagcaaaaagaauggcugucuuaggagauacagcaugggauuucgguucuguuggcggagcuuugaacaguuugggcaaaggaauacaucaaauauuuggggcagcauuuaagagcuuauuuggagguaugucaugguucucacaaauauuaauaggaacauuacuaauguggcuaggauuaaauacgaaaaauggcagcauuucacuaaugugucuagcauuagguggagucuuaauauuucuaucaacagcaguaucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4865 - RNA, 2284 nt, Artificial Sequence
  KU870645.1 prME-short mRNA Design 1 opt
gggagaaagcuuaccaugacaucagugggaauugugggauuauuauuaacaaccgcuauggcagcagaagucacuagaagaggaucugcauauuacauguaucuagauagaaacgaugcaggagaagcaauaaguuucccaacaacauuagguaugaauaaauguuacauacagauaauggaucuaggucauaugugcgaugcaacuaugaguuaugaaugcccaauguuagaugaaggaguagaaccagaugauguagauuguugguguaacacaacaucaacauggguagucuacggaacaugucaucauaagaaaggugaagcuagaagaagccgcagggcaguaacuuuaccgucgcacucaacaagaaaacuucagacaagaagucaaacuugguuagaaaguagagaauauacaaaacauuuaauccguguagaaaauuggauauuaaggaacccaggauucgcauuagcagcagcggcaauagccugguuacuagguucaagcacgucacaaaaaguaauauacuuagucaugauacuguuaauugcaccagcauauagcauucguuguauuggcguaucuaacagagauuucguugaaggaaugucgggaggaacauggguugauguaguucuagaacauggcgguuguguaacaguaauggcccaagauaaaccaacaguagauaucgaacucguaacuacaacgguauccaauauggcagaaguucgaaguuauuguuacgaagcaaguauaagugacauggccuccgauucaagauguccuacgcagggugaggcuuaucuagacaaacaaucggacacacaauauguauguaaaagaacauuaguagauagaggauggggaaauggauguggacuauuuggaaaaggaaguuuaguaaccugugcaaaauuugcuugcaguaagaaaaugacagguaaaagcauacaaccagaaaaucuugaauauagaauaaugcugagcguacacggcagccaacacucuggaaugauuguaaacgauacugggcaugaaacagaugaaaaucgagcaaaaguagaaauaacaccaaacagcccaagggcugaagcaacccuggguggauuuggaaguuugggucuagauugcgaaccaagaaccggucuagauuucucagauuuauauuauuuaacgaugaauaauaaacauugguuaguacauaaagaaugguuccaugauauaccauuaccauggcaugcaggagcugauacaggaacaccacauuggaauaacaaagaagcauuaguagaguucaaagaugcacacgcaaaaagacaaacuguaguaguacuaggaagucaagaaggagcaguccacacagcauuagcaggagcucuagaagcagaaauggauggugcaaaaggccgacuaucuucuggacauuuaaaauguagauuaaaaauggacaaacuaagauuaaaaggagugucauacucauuaugcacagcagcauuuacauuuacaaaaauuccagcagaaacacuacauggaacaguaacuguagaaguccaauaugccggaacagacggaccuuguaaaguaccagcacaaauggccguagauaugcaaacauuaacaccuguagguagacuaauuacagccaauccaguaauaacugaauccacugaaaauagcaaaaugaugcuagaacuggauccuccauuuggagauucauauauagucauagggauaggagagaaaaagauaacacaccacuggcauagaucuggaaguacuauagguaaagcauucgaagcaacaguaagaggugcaaaaaggauggcaguauuaggagacacagccugggauuucggaucaguaggaggugcauuaaauucauuaggaaaagguauccaccaaauuuucggagcagcuuuuaaaucuuuauucgguggaaugaguugguuuucacaaauauuaauuggaacuuuacuaauguggcuaggauuaaauaccaaaaauggaucaauaagucuuaugugucuagcauuagguggaguacuuauauuucuaaguacagcaguaucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4866 - RNA, 2284 nt, Artificial Sequence
  KU729217.2 prME-short mRNA Design 1 opt
gggagaaagcuuaccaugacuucaguaggaaucgucggacuuuuguuaacaacggccauggcugcagagguaacaagaagaggaucagcuuauuacauguauuuagauaggaaugaugcuggagaagccauaaguuucccaacuacacuaggaaugaauaaauguuauauucaaauaauggauuuaggucauaugugugacgccacuaugaguuacgaguguccaauguuggaugaaggcguagaaccagacgauguugacuguuggugcaacaccacaucaacauggguaguauaugguacaugucaucauaagaaaggagaagcaagaagaucaagaagggcaguaacacucccuucacauucaacaagaaaauuacaaacgagaagccagacauggcuagagucaagagaauauacuaaacacuuaauaagaguagaaaauuggauauucagaaauccaggguuugcauuagcagcagcagcaauagcuugguuacuaggaaguaguacgucacaaaaaguaauauaucuuguaaugauuuuauuaauugcaccagcuuauagcauuagauguauaggcguuuccaaccgugauuuuguugaaggaaugucuggaggaacauggguugauguagugcuagaacacggaggauguguaacaguuauggcacaagauaaaccaacaguggacauagagcuaguaucaacuacugucagcaauauggcggaaguaagaucauacuguuacgaagccacaauaagugauauagcaucagacucaagaugcccaacacaaggagaagcauaucuagacaaacaaucagacacucaauauguauguaaaagaacauugguagauagaggauggggaaauggaugcggauuauuuggaaaaggcaguuuaguuacaugugcaaaauuugccugcaguaagaaaaugacuggaaaaucaauacaaccugaaaauuuagaauauagaauaauguuaucaguacaugggucucagcacucaggaaugauagucaaugacacaggacacgaaacugaugaaaauagagcuaaaguugaaauaacaccaaauagcccacgagcagaagcaacauuaggaggcuuuggaaguuuaggacuagauugugaaccaagaacaggccuagacuuuucagaucuauauuauuuaacaaugaacaacaaacauuggcuaguacacaaagaaugguuccacgauauaccauugccauggcacgcaggagcagacacaggaacuccacauuggaauaauaaagaagcucuuguagaauuuaaagaugcacaugcaaaaagacaaacagccguaguacuagguucacaagaaggagcuguacacacagcacuagcuggagcauuagaggcagaaauggauggagcuaaaggaagauugucgagugggcaucuaaaaugcagauuaaaaauggacaaauuacgauuaaaaggaguaucuuauucacuaugcaccgccgcauuuacauuuacaaaaauaccggcagaaaccuuacauggaaccguaacaguugaaguacaauaugcaggaacagaugguccauguaaaguaccagcucaaauggcaguugauaugcaaacauuaacaccagucggaagacuuauaacagcaaauccaguaauaacagaauccacagaaaauagcaaaaugaugcuggaacuagauccuccauuuggggacucauacaucguaauaggaguaggagaaaagaaaauaacgcaccauuggcauagaagugguaguacaauaggaaaagcauucgaagcuacaguaagaggagcgaaaagaauggcaguauuaggugacacugcuugggauuuuggaucagucggcggggcauuaaauucauuagguaaaggaauacaucagauuuuuggagcagccuuuaaaucauuauuuggugggaugaguugguuuucacaaauauuaauaggaaccuuacuuaugugguuaggcuuaaauacuaaaaaugguagcauaucacuuaugugcuuagcauuagguggagucuuaauauuuuuaucuacagcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4867 - RNA, 2284 nt, Artificial Sequence
  KX087101.3 prME-short mRNA Design 1 opt
gggagaaagcuuaccaugacaagcguagguauaguugguuuacuuuuaacaacagcaauggcagcagaaguaacuagaagaggaagugcauauuauauguaccuagaucguaacgacgcgggugaagcaaucagcuuucccaccacuuuaggaaugaauaaauguuacauacaaauaauggacuuaggacauaugugugaugcaacaaugaguuaugaauguccaaugcuagaugagggaguugaaccagaugaugucgacuguugguguaauacaacaaguacuuggguuguauaugggacuugucaucauaagaaaggugaagcuaggagaucaagacgcgcagugacacuaccuagucauagcacuagaaaacuccaaacacgaucacaaacaugguuagaaucacgcgaauacacaaaacacuugauacguguagaaaacuggauauuucguaacccagguuucgcacuggcagcagcagcaauagcauggcuauuaggaaguagcacuucacaaaaagucauauaucuagucaugaucuuauuaauagcaccagcauauaguauaagaugcauagggguaucaaacagagauuucguagaaggaaugaguggaggaacauggguagacguaguacuggaacacggaggaugcguaacuguaauggcacaagacaaaccuacaguagauauagaguuaguaacgacuacaguuaguaacauggcagaaguuagaaguuauuguuaugaagcaaguauaagugauauggcaagcgauaguagaugcccaacccaaggagaagcauauuuagauaaacagagcgacacucaauauguuuguaaaagaacuuuaguagacaggggaugggggaacggauguggacuauuuggaaaaggauccuugguuacaugugcaaaauuugcauguucaaagaaaaugacaggaaaaucaauccagccugaaaaccuugaauacagaaucaugcuaagcguacaugggucacaacacucaggaaugauaguaaacgauacgggacaugaaacagaugaaaacagagcaaaaguggaaauaaccccaaauagcccacgagcagaagcaacucuuggagguuuuggaucucuaggauuagauugugaaccccgaacuggucuagauuuuagugacuuauauuaucucacuaugaauaacaaacacugguuaguacauaaagaaugguuccaugauauaccacuacccuggcaugcuggagcagacacgggaacaccacauuggaauaauaaagaagcucuaguagaauuuaaagaugcacacgcaaaaagacagacaguagugguauuaggaucacaagaaggugcaguacauacagcacuugcaggagcccuagaagcagaaauggacggagcaaaaggccgacuaaguaguggacaucuaaaauguagauuaaaaauggacaaauuaagacuaaaaggaguaucuuauucauuauguacagcggcauuuacauuuacuaaaauacccgcugaaacacuacacggaaccguaacaguagaacuacaauaugcagguacagaugguccauguaaaguaccugcccaaauggcuguagauaugcaaacguuaacaccaguuggaagguuaauaaccgcaaacccaguaauaacagaaucaacggaaaacagcaaaaugauguuagaauuagacccaccauuuggugacucauauauaguaaucggaguaggagaaaagaaaauaacacaucacuggcauagaaguggaaguacuauaggaaaagcauuugaagcaacaguaagaggagcaaaaagaauggccguauuaggagauacugcuugggauuuugguucaguagguggagcacuaaacagucuaggaaaaggaauacaccaaauauuuggugcagcauuuaaaagucuauucggcggaaugucgugguuuucacaaauacuaauagguacacuauuaauguggcuuggacuuaauacuaaaaauggaagcaucagcuuaauguguuuagcauuaggaggcguccuaauauucuuaaguacagcaguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4868 - RNA, 2284 nt, Artificial Sequence
  KY014317.1 prME-short mRNA Design 1 opt
gggagaaagcuuaccaugacaagcguaggcauaguaggauuacuauuaacaacagcaauggcugcagaaguaacaaggcgaggaagugcauauuauauguauuuagauagaaaugacgcaggcgaagcaauaaguuuuccaacaacauuaggaaugaacaaauguuacauacaaauaauggauuuaggacauaugugugacgcaacaaugucauaugaauguccaauguuagaugaaggaguggaaccagaugauguagacuguuggugcaauacuacaaguacguggguaguauacggaacgugccaucauaaaaaaggagaagcccgaagaagccgaagagcuguaacucuacccagccauucuacccgcaaauuacaaaccagaucacaaaccugguuagaaucaagagaauauacaaaacacuuaauuagaguugagaauuggaucuuuagaaaucccgguuuugcauuagcagcagcggcaaucgcauggcuauuaggaucuucaacaucacaaaaaguaauauacuuaguaaugauauuauuaauagcuccagcauacaguauaagauguauaggaguaucaaauagagauuucguugaaggaaugucuggaggaacauggguagauguaguacuagaacacggcggauguguuacaguaauggcacaagauaaaccuacaguagauauagagcucgucacaacuaccguuucaaauauggcagaaguaaggucauauugcuacgaagcaagcaucagugauauggcaagcgauucaagauguccaacucaaggagaagcauaucuagacaaacaaucagacacacaauauguaugcaaaagaacacuuguagacaggggaugggguaaugggugcggccuauucgguaaagguucgcuaguaacaugcgcgaaauuugcaugcaguaaaaaaaugacagguaaaaguauucaaccagaaaacuuagaauauaggauaaugcuaucuguucauggaucacaacacagcggaaugauaguaaaugauacuggacacgaaacagaugaaaaccgagcaaaaguagaaauaacaccaaauagcccaagagcugaagcaacucuagguggauuugguucacuagguuuggacugugaaccaagaacaggacuggauuuuucagaucuauauuauuugaccaugaacaacaaacauuggcuuguacauaaagaaugguuccaugauaucccauuaccauggcaugcaggcgcggauacaggaacaccacauuggaauaacaaagaagcacuaguggaguucaaagacgcacacgcaaaaagacagacaguaguaguacuaggaucacaagaaggagcaguucauacagcuuuagccggcgcuuuggaagcagaaauggauggagcaaaagguagacuuaguuccggccaucuuaaaugucgacugaaaauggauaaacuacgacuaaaaggagugucauauucacucuguacagcagcauuuacuuucacuaaaauaccagcagaaacauuacauggaacuguaacaguagagguacaauaugcuggcacagacggcccauguaaaguaccagcacaaauggcugucgauaugcagaccuuaacuccuguugguagacuaauaaccgcaaauccaguaauuacagaaaguauagaaaauagcaaaaugaugcuugaacuagauccaccauuuggugauucguauauaguuauagggguuggagaaaaaaaaauaacucaucauuggcauagaucaggaucaacuauaggaaaagcauuugaagcuacaguaagaggagcaaaaaggauggcaguuuuaggugacacagcaugggauuuugguucuguaggaggagcauuaaacucccuagguaaaggaauacaucaaauauuuggugcagccuuuaaaagccuauuuggagguaugucuugguuuucacaaauauuaauaggaacacuucuaauguggcuaggacuaaacacuaagaauggaaguaucagcuuaauguguuuagcacucggaggaguacuaauauuuuuaucaacagcaguguccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4869 - RNA, 2284 nt, Artificial Sequence
  KU758876.1 prME-short mRNA Design 1 opt
gggagaaagcuuaccaugacaucaguuggaauaguaggucuauuacuaacaacagcaauggcugcagaaguaacucggcguggaagcgcuuauuacauguacuuagacagaaaugaugcaggcgaagcaauaucauuuccaacaacacuaggcaugaauaaaugcuacauacaaauaauggauuuagggcauaugugugaugcaacuaugucuuacgaauguccaauguuagaugaaggcguagaaccagaugauguagauuguuggugcaauacaacuucaacauggguaguauacgguacaugucaucacaagaaaggagaagcuagaagaucaaggagagcgguaacacuaccuagucauaguacaagaaaacuacaaacucgaucacaaaccugguuagaaucacgugaauacacaaaacauuuaauaaggguagaaaauuggauauucagaaauccagguuuugcacuggcagcagcugcaauagcauggcuuuuaggaucaagcacaagucaaaaagucauauaccuggugaugauauuauuaauagcuccagcuuauaguauacgauguauaggaguaaguaauagagauuucguagaaggaaugucaggagguacaugggucgaugucguucuagaacauggaggaugugucacgguaauggcacaagacaaaccaacaguagauauugaauugguaacuacaacuguaagcaacauggcagaaguaagaucauauuguuacgaagcaucuauaagugacauggcaucagauucacgaugcccaacacaaggugaagcauauuuagauaaacaaucugacacucaauauguauguaaaagaacucuaguagaucgaggauggggaaaugguugugggcuauuuggaaaaggaagccuaguaacaugcgcaaaauuugccuguucaaagaaaaugacaggaaaaucaauccaaccagaaaaccucgaauauagaauaaugcuaucaguacacggaucacaacacagcggaaugauaguaaaugacacaggacaugaaacagacgaaaacagagcaaaaguagaaauaacacccaauagccccagagcugaagcaacauuaggaggauucggaaguuuaggacuugacugugaaccaagaacaggauuagacuucagcgaccuauauuauuuaacaaugaauaacaaacauuggcuaguacacaaagaaugguuucacgauauaccuuuaccauggcacgcaggcgcugacacugguacuccacacuggaauaacaaagaagcacuuguagaauuuaaagaugcgcaugcaaaaagacaaacaguagugguacuaggcucucaagaaggugcaguacauacagcacuagcaggcgcauuagaagccgaaauggauggcguaaaaggaagacuaucaucggggcauuuaaaaugucgucuaaaaauggacaaauuaagacuaaaaggaguaucguauucauuaugcaccgcagcauucacauuuacaaaaauaccagcagaaacauuacauggaacaguaacaguagaaguacaauaugcagguacagacggaccauguaaaguuccagcacaaauggcaguggacaugcaaacauuaacaccgguaggaagauuaauaacugcaaauccaguuaucacggaaaguacagaaaauuccaaaaugauguuagaguuagacccuccauuuggagauaguuauauaguuauugguguuggggaaaagaaaauaacucaucacuggcauagaucaggcaguacgauaggaaaagcauuugaagcuacaguacgaggcgccaaaagaauggcaguauuaggagauacagcaugggacuuugguagcguagguggagcccuaaauucauugggcaaagguauucaucaaauauuuggagcugcauuuaaaagccucuucgguggaaugaguugguuuucucaaauacuaauaggaacauuauuaaugugguuaggacuaaauacuaaaaaugguucuauuagcuuuauguguuuggcacuaggaggagucuugauauuucuaaguaccgcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4870 - RNA, 2284 nt, Artificial Sequence
  KU758874.1 prME-short mRNA Design 1 opt
gggagaaagcuuaccaugacaucuguugguaucguaggauuauuacucacaacagcaauggcggccgaaguaacuagaaggggaucagcauauuauauguaucuagauagaaacgaugcaggagaagccauaaguuuuccgacaacauuaggcaugaacaaaugcuauauacaaauaauggauuuagggcauaugugugaugcaaccaugagcuaugaaugcccaauguuagacgaaggaguagaaccagacgacguagauuguugguguaacacgacaaguacaugggucguauacggaacuugucaucauaaaaaaggagaagcuaggcguucaagaagagcaguaacauuaccaucacauucaacacgaaaacuucaaacaagaucacaaacauggcuagaaucaagagaauauacuaaacauuuaauaaggguugaaaacuggauauuuagaaacccaggauuugcccuagcugcagcagcaaucgcauggcuacuaggaucaaguacaagccaaaaaguaauauaucuaguaaugauacuauuaauagcuccagcauacucgauuagaugcauagguguaucaaauagagacuucguagaaggaauguccggaggaacauggguagacguaguguuagaacauggaggauguguuacaguaauggcacaggacaaaccaaccguugacauagaauuaguuacaacaacaguuaguaacauggcugagguacguucauauuguuaugaagcaucaauaucagacauggcaucagauucacgaugucccacucaaggugaagcauacuuagauaaacaaagcgacacacaauacguuuguaaacgaacacuaguagauagaggaugggggaauggauguggccuauuuggaaaaggaagccuaguaacaugugcuaaauuugcauguaguaaaaaaaugacaggaaaaagcauucaaccggaaaacuuagaauauagaauuauguuaucaguacaugguucacaacauucagggaugauaguaaaugauaccggacaugaaacugacgaaaacagagcaaaaguagaaauaacuccuaauaguccaagagcagaagccacauuagggggauuugggagucuaggacuagauugcgaaccuagaacaggauuagauuuuucagaucuauauuauuuaacaaugaacaauaaacacuggcuuguucauaaagaaugguuucacgacauaccacuaccauggcaugcaggagcagauacaggaacaccacauuggaacaauaaagaagcauuaguggaauuuaaagaugcacaugcaaaaaggcaaacugucguaguucuagguucccaagaaggugcuguacauacugcacuagcaggggcacucgaagcagaaauggacggagcuaaaggaaaacuaaguucagggcaccuaaaaugcagauuaaaaauggauaaauuacguuuaaaaggaguaucauauucauugugcacagcagcauuuacauuuacaaaaauuccggccgaaacguuacauggcaccguuacgguagaaguacaauacgcaggaacagaugggccauguaaaguaccugcccaaauggcaguugauaugcaaacacugacaccgguugggagacuaauuacugcuaacccaguaauaacugaaucaacagaaaauucaaaaaugauguuagaauuagauccaccauucggcgauagcuauauuguaauaggaguaggugaaaaaaaaauaacacaccauuggcacaggagcgguaguacaaucggcaaagcauuugaagcaacuguuagaggagcuaaaagaauggcaguguugggcgauacagcaugggauuuugggaguguaggaggggcacucaacucauuaggaaaagguauacaucaaauauucggagcagcuuuuaaaucauuauucggaggaaugagcugguuuagucaaauacuuauaggaacacuauuaaugugguuaggauuaaauacaaagaacggaagcauaucauuaauguguuuagcacuuggaggaguuuuaauauuucuaaguacagcugucagugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4871 - RNA, 2284 nt, Artificial Sequence
  KY317939.1 prME-short mRNA Design 1 opt
gggagaaagcuuaccaugacaagcguaggaauuguaggacuacuguuaacaacagcaauggccgccgaaguaacaagaagaggcagcgcauauuauauguacuuagauagaaaagaugcuggagaagcaaucuccuuuccaacaacauuagguaugaauaaauguuauauacaaauaauggaucuaggacauaugugugacgcaacaaugucuuaugaauguccaauguuagaugaaggaguagaacccgaugauguagacugcugguguaauacgacaucaacuugggugguauacggaacaugccaccauaaaaaaggagaagcaaggagaucacguagagcaguuacacuuccuucucauucaacuagaaaauuacaaacacgaagccaaacuugguuagaaagcagagaauauacaaaacauuuaauaagaguagaaaacuggauauucagaaauccaggauuugcacucgcagcagcagcaauagcauggcuauuggggucaagcacaucacaaaagguaauauacuuaguuaugauauuauuaauugcaccagccuauucuauaagauguauaggaguaucuaacagagauuuuguugaagguaugucaggcggaacauggguagaugugguucuugaacaugguggauguguaacaguaauggcacaagauaaaccaacaguagauauagaauuaguaacaacaacaguaaguaacauggcagagguaagaaguuauuguuaugaagcaaguaucucagauauggcaagcgacucuagaugcccaacacaaggagaagcauaucuagauaaacaaagugacacacaauauguauguaaaagaacacuaguagauagaggauggggaaauggauguggacuuuuuggaaaagguucguuaguuacuugcgcaaaauuugcauguucaaaaaaaaugacuggaaaaaguauacaaccagaaaacuuagaguauagaauaauguuaucaguacacgggucucaacauaguggaaugauuguuaaugacacuggacaugagacagaugaaaauagagcaaaaguagaaauaacuccaaacucaccccgugcagaagcgacauuaggaggauuugguucauuaggauuagauugugaacccaggacgggacuagauuuuagugaucuauauuaucuaacuaugaauaauaaacauugguuaguacauaaagaaugguuucacgacaucccauuaccauggcacgcaggagcagauacaggaacaccucauuggaauaauaaagaagcauuaguugaauuuaaagacgcucaugcaaaacgucaaaccguaguuguacuagguagccaagaaggagcaguacauacugcauuagcaggagcauuagaagcagaaauggauggcgcgaaagguagauuaagcaguggccauuuaaaauguagacucaaaauggauaaacucagauuaaaaggaguuucauauagucuauguacagcagcauuuacauuuacaaaaauaccagccgaaacacuccauggaaccguaacaguagaagugcaauacgcaggaacagauggaccgugcaaaguaccagcccaaauggcaguagauaugcaaacauuaacaccuguaggaagauuaauaacagcaaauccaguaauuacagagucaacagaaaacagcaaaaugauguuagaacuagaucccccauucggagauaguuauauuguaauagguguaggugaaaaaaagaucacacaucauuggcacagaucaggaucaacaauugggaaagcuuucgaagcaacagucagaggugcaaaacgaauggcaguacuaggagauacagcgugggacuucggaaguguagguggagcacuaaacucacuggggaaaggaauacaccaaauauucggagcagccuuuaaaucacuauuugggggcaugucuugguucucucaaauacuaauuggaaccuuauuaauguggcuaggacuaaacacuaaaaauggaagcaucaguuuaaugugucuagcacuuggagguguuuuaauauucuuaucgacagccguuuccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4872 - RNA, 2284 nt, Artificial Sequence
  KY014314.1 prME-short mRNA Design 1 opt
gggagaaagcuuaccaugacaaguguaggaauuguaggacuauuauuaacaacagcuauggcugcagaaguaacaagaagaggcagugcauacuauauguauuuagauagaaaugacgcuggagaagcaauuagcuucccaacaacauugggaaugaauaaaugcuacauacaaauaauggauuuaggccauaugugugaugcaacaaugaguuaugaaugccccaugcuagacgaaggaguugaaccagaugauguagauugcugguguaauacaacuucaacauggguuguuuaugguacaugucaccauaaaaaaggagaagcaaggcguucaagacgagccguaacacucccuucgcacucaacucgaaaauuacaaacccgaagccaaacauggcuagaaucaagagaauauacaaaacaucugauaagagucgaaaacuggauauuuagaaauccaggauuugcacuagcagcagcagcaaucgcauggcugcuugggagcucaaccucucaaaaagugaucuaucuuguaaugauacuguugauagccccagcauacucaauaagauguauagguguaagcaauagagauuucguagaaggcaugucaggaggaacauggguugauguaguauuagaacacggagguugcguuacagugauggcacaagacaaaccaacaguagacauagaacuaguaacaaccacuguaaguaauauggcagaaguacgaucuuauuguuaugaagcuaguauuucagauauggcaucggauucaagguguccuacucaaggugaggcauaccuagacaagcaaucagacacucaauacguaugcaaaagaacacuaguugauagaggauggggaaauggauguggauuguucggaaaagguucauugguaacaugugcaaaauuugcgugcucuaaaaaaaugacagguaaaucuauacaaccggaaaacuuagaguauagaauaaugcuaaguguacauggcucucaacauucuggaaugauuguaaaugauacaggacaugaaacagaugaaaauagagcaaaaguagaaauaacgccaaauaguccacgagcggaagcaacacuaggaggauuugguaguuuaggauuagacugugaaccgagaacaggauuagauuucagcgaccuauauuauuuaacgaugaauaauaaacauugguuaguacauaaagaaugguuucaugacauuccccucccauggcacgcaggggcagacacagggacaccacauuggaacaauaaagaagcacuaguagaauuuaaagaagcacacgcaaaaagacaaacaguuguaguacuaggaagucaagaaggagcaguacauacagcacuagcaggagcuuuagaagcagaaauggauggagcaaagggaagacuaucuucuggacacuuaaaauguagauuaaaaauggauaaacugagacuaaaagguguaucauauucguuauguacagcagccuucacauuuacuaaaauaccagcagaaacucuacauggaacgguuacaguagaaguacaauaugccggaaccgauggcccgugcaaaguaccagcacaaauggcaguggauaugcaaacauuaaccccaguaggaagauuaauaacagcaaauccaguaauaacagaaucaacagaaaauagcaaaaugauguuagaauuagauccaccuuuuggagauagcuacauaguaauaggagucggagaaaaaaaaauaacucaccauuggcacagaagcggaucaacaauaggaaaagcauuugaggccacaguuagaggagcaaaaagaauggcaguacuaggagacacugccugggauuuuggaagcguuggaggggcauuaaauagucuugguaaagggauucaucaaauauucggggcagcauuuaaaucacuauuuggaggaaugaguugguucucacaaauauugauaggaacauugcuaaugugguuaggacuaaauacaaaaaauggcagcauaagccucaugugucuugcucuaggaggaguucuaauauuuuuaaguacugcaguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4873 - RNA, 2284 nt, Artificial Sequence
  KX447517.1 prME-short mRNA Design 1 opt
gggagaaagcuuaccaugacaaguguuggaauaguaggauuacuacuaacuacugcaauggcagcagaaguaacuagaagaggcucagcuuauuacauguauuuagacaggaacgaugccggcgaagcgauaaguuuuccuaccacacuaggaaugaacaaauguuacauacaaauaauggauuugggacauaugugugaugcuacgaugagcuaugaguguccaaugcuagacgaaggaguugaaccugaugacguagauuguugguguaacacaacaagcacauggguuguauauggaacaugucaucacaaaaaaggagaagcuagaagaucaagaagagcagucacauuaccaagucauagcacaagaaaacuacaaacaagaucacaaacaugguuagaaucaagagaauauacaaaacaccuuauaagaguugaaaauuggauuuuuagaaauccaggauuugcuuuagcagcugcagcaauagcaugguuacucgguucuucaacaagccaaaaaguaaucuaucuaguaaugauauugcuaauugccccagcguacucuauucgauguauuggcguaucaaacagagauuucgucgaaggaaugucaggaggcacauggguagacguuguacuagaacacggagggugcguaacaguaauggcacaggacaaacccacaguugauauagaauuaguaaccacaacgguaucaaacauggcggaaguuagaucuuauuguuaugaggcaaguauaagugauauggcaucagauaguagauguccaacccaaggugaagcauacuuagauaaacaaucagacacacaauacguauguaaaaggacacugguagacagaggauggggaaauggauguggauuauuugguaaaggaaguuuaguaacaugugcaaaauuugcauguucaaaaaaaaugacgggaaaaaguauacaaccagaaaauuuagaauauagaauuauguuaaguguucauggaagccaacauagcgguaugauagugaacgacacaggucacgaaacugaugaaaacagggcgaaaguagaaauaacaccaaauaguccgcgcgcagaagcagcuuuaggaggauucggaucacuggguuuagauugcgaaccaagaacagguuuagauuucagugacuuguacuaccuaacaaugaauaauaaacauugguuagugcacaaagagugguuucaugauauaccauugccauggcaugccggagcagauacaggcacgccacauuggaauaauaaagaggcguuaguugaguucaaagaugcacaugccaaacgacaaacaguaguaguauuaggaucacaagaaggggcaguucacacagcauuagcaggagcauuagaagcagaaauggacggagcuaaaggaagauuaagcucaggacaccuaaaauguagauuaaaaauggauaaguugcgauuaaaagguguaucuuacucacuuuguacagcagcuuucacauuuacaaaaauacccgccgaaacacuacacgguacaguaacaguagagguacaauaugccggaacagauggaccauguaaaguuccagcacagauggcaguagauaugcaaacauuaacaccugucggaagauuaauaaccgcaaauccagugauaaccgaaucuacugaaaauucaaaaaugauguuagaauuagacccuccauuuggagauucauacauaguuauaggaguaggagagaaaaaaauuacacaucauuggcauagauccgguucaacuauaggaaaagcauuugaagcuacaguaagaggcgcaaaacguauggcaguauuaggagacacggcaugggauuucggaucaguaggaggagcauuaaacucauuaggaaaaggaauacaccaaauuuucggugcggccuuuaaaucauuauuugguggaaugagcugguuuucgcaaacauuaauaggcacuuuacucaugugguugggacuuaauacaaaaaauggaagcauaucacucauguguuuagcacugggaggaguacuuauauuuuuauccacugcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4874 - RNA, 2284 nt, Artificial Sequence
  KU926310.1 prME-short mRNA Design 1 opt
gggagaaagcuuaccaugacaaguguagguauuguaggacuuuuauuaacuacagcaauggcagcagagguuacuagaagaggaucugcguauuauauguaucuagacagaaaugacgcaggagaagcaauaucuuuuccuacgacauuaggaaugaauaaaugcuauauacaaauaauggauuuaggccacaugugcgaugcaaccaugucauaugaauguccaauguuagaugaaggaguugaaccagaugauguagauugcugguguaauacaacaucaaccuggguaguauauggaaccugucaccacaaaaaaggcgaagcaagaagaaguagaagagcaguaacauuaccaucacauagcacacgaaaacuucaaacacgaagccaaacauggcuugaaaguagagaauauacuaaacaucuaauaagaguagaaaacuggauauucagaaauccaggcuuugcauuagcagcagcugccauugcauggcuauuaggcaguucaacaucacaaaaaguaauuuauuuaguaaugauucuauuaauugcaccugcauauaguauaaggugcauaggaguuuccaauagagauuuuguagaaggaaugucaggagguacauggguagauguaguucuagaacauggugguuguguaacaguaauggcucaggauaaaccaacaguagauauagaacuaguaacgacaacaguaagcaacauggcagaaguuagaagcuauugcuacgaagcaaguauaucagauauggcaagcgauucacgauguccaacacaaggagaagcuuaccuugacaaacaaucugauacucaauauguaugcaaaaggacguuaguagaucgugguuggggaaaugguuguggcuuauucggaaaaggaagucuaguuacaugcgccaaauuugcauguaguaaaaagaugacagguaaaucaauacaaccagaaaauuuagaauaucgaaucauguuaucaguacaugguucacaacauucugguaugauuguaaaugacacaggacaugaaacagacgaaaauagagcaaaaguagaaaucacaccaaacucuccaagagcugaagcaacuuuaggaggguucggcucguuaggauuagauugugaaccaagaacgggacuagacuuuucagaucuauauuauuugacaaugaauaauaaacacuggcuaguucauaaagaaugguuucaugauauaccacuaccauggcaugccggagcagacacuggaaccccccauuggaauaacaaagaagcacuaguagaauuuaaagaugcucacgcgaaacgacaaacuguaguaguacuuggaucacaagaaggagcaguacacacagcauuagcaggagcuuuagaagcugagauggacggcgcuaaaggacgacuaaguucaggccauuuaaaaugcagauuaaaaauggauaaacuaagauuaaaaggaguuucauauucacuauguacagcagcuuuuacauuuaccaaaauaccugcagaaacauugcauggaacaguuacaguagaaguacaauacgcuggagcugauggaccuuguaaaguacccgcucaaauggcaguagauaugcagacauuaacaccagucggaagauuaauuacagccaauccaguaauuacagaaucaacggaaaauucaaaaaugauguuagagcuagacccgccauuuggagauucauauauugugaucgguguaggcgaaaaaaaaauuacacaccauuggcauagaucagguucuacaauaggcaaagcguuugaagcaacugugaggggcgcaaaaagaauggcaguauuaggagauacugcaugggauuucggaaguguaggaggagcacuaaacucccugggaaaagguauccaucaaauauuuggagcggcguucaaaucauuauucgguggaaugucaugguucucacaaauccucauaggaacuuuauuaaugugguuaggacuuaauacaaaaaauggcaguauaucauuaaugugccuagcacuaggaggagucuuaauauuuuuaaguacugcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4875 - RNA, 2284 nt, Artificial Sequence
  KU922923.1 prME-short mRNA Design 1 opt
gggagaaagcuuaccaugacaucagugggaauaguagguuuacuacuaacaacagcaauggcagcagaaguaacaagaagaggaucugcauauuauauguauuuggauagaaacgaugcaggggaagcaaucaguuuuccuacaacguugggaaugaauaaauguuauauacaaauaauggaccuaggacauaugugugaugcuacaaugucguaugaaugcccgaugcuggaugaagggguagaaccagaugauguagacuguugguguaauacaaccaguacaugggugguauauggaacaugucaucauaaaaaaggugaggcucgacgaaguaggagagccguaacauuaccuucacauucaacaagaaaauuacaaacaaggucacaaacaugguuagaaaguagagaauauacaaaacaucuaauuagaguugaaaacuggauauuuagaaacccaggguucgcuuuggcagcagcagcaauagcaugguuauuaggaagcucaacaucucaaaaaguuauauaucuagucaugauauuacuuauagcauuagcuuauuccauacgauguaucggaguaucaaauagagauuucguagaaggaaugucaggaggaacauggguugacguaguguuagaacaugguggcuguguaacaguaauggcacaagauaagccaacaguagacauugaauuaguaacuacaacaguaaguaauauggcagaaguaagaucuuauuguuacgaagcaaguaucagcgauauggccuccgauucaagaugcccgacacaaggugaagcauauuuagauaaacaaagcgauacgcaauacguauguaaacguaccuugguagacagagguugggguaauggaugcggauuauuuggaaaaggcucacuuguuacgugugcaaaauucgcaugcucaaaaaaaaugacuggaaaauccauacaaccagaaaaucuagaauauagaaucaugcuauccguacauggaucccaacauucagguaugaucguaaaugauacagggcaugaaacagaugaaaauagagcgaaaguagaaauaaccccaaauaguccaagagcugaggcaacuuuaggaggauuuggaucacuaggcuuagacugcgaaccgaggacagguuuagauuuuagugaucuauauuaucuuacuaugaauaauaaacauugguugguacauaaagaaugguuucacgauauaccauuaccauggcaugcaggagcugauacaggaacaccacauuggaauaauaaagaagccuugguugaauuuaaagacgcacaugcaaaacgacaaacaguagugguauuaggaagucaagaaggggccgugcacacagcauuagcuggagcucuagaagcagaaauggauggagcaaaaggaagacuaucaucaggacaccuaaaaugccgguuaaaaauggacaaacuaagacuaaaaggggugaguuacucauuguguacugcagcauuuacauucacaaagauaccagcagaaaccuuacaugguacugucacaguagaaguacaauaugcaggaacagauggaccauguaaaguaccugcacaaauggcaguagacaugcagacauuaacaccaguagguagacuaauaacugcaaaucccguuauaaccgaaucaaccgaaaauaguaaaaugauguuagaauuagauccaccuuuuggggauucauauauagucauaggaguaggagaaaaaaaaaucacucaucauuggcacagaagcggaucaacaaucgggaaagcauucgaagccacaguuagaggagcaaaaagaauggcagucuuaggagauacggccugggauuuuggaaguguagggggggcauuaaauucauugggaaaaggaauacaucaaauauuuggagcagcauuuaaaaguuuguucgguggaaugucaugguuuucucaaauacuaauaggaacucuauuaauguggcuaggucuuaauacaaaaaaugggaguauaucauuaaugugccuagcauuagguggagucuugauauuccuaagcacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4876 - RNA, 2284 nt, Artificial Sequence
  KY075937.1 prME-short mRNA Design 1 opt
gggagaaagcuuaccaugacaaguguaggaauaguuggauuacucuuaacaacagcaauggcagcagaaguaacaagaagggguucagcauauuauauguaucuagaucgaaaugaugcaggagaagcaauaaguuuucccacaacuuugggaaugaacaaauguuauauacaaauaauggacuugggacauaugugugaugcuacuauguccuaugaauguccaauguuagacgaaggaguagaacccgacgauguugauugcuggugcaacacaacaaguacuuggguuguauacggaacaugccaucacaagaaaggagaagcaagaagaucaagacgagcaguaacuuuaccaagucauaguacaagaaaauuacaaacacgaucacagacauggcucgaaucaagggaauauacaaaacaucuaauuagaguagaaaauuggauauucagaaauccaggauuugcauuagcagcugcagcaaucgcauggcuuuuagguucaucgacuucacaaaaaguuauauauuuaguaaugauacuucuaauagcccccgcauauucaauucggugcauuggagucucgaaucgagacuuuguggaaggaaugucagguggaacauggguagauguagucuuagaacauggaggaugcguuacuguaauggcucaagauaaaccuacaguagauauagagcuaguaacaacuacaguaaguaauauggcagaaguaagaaguuauuguuaugaggcaaguauaucugauaugguaucagauucaagauguccaacacagggagaagcauaccuagauaaacagucagauacucaauauguuuguaaaagaacauuaguagaucgaggaugggguaauggcuguggauuauuuggaaaaggaucacuuguaacaugugcgaaauuugcauguucaaagaaaaugacaggcaaaucaauucaaccagaaaauuuagaauacagaauaaugcuaaguguacacgguucacaacauuccggcaugauaguaaacgacacuggacaugaaacugacgaaaauagagcaaaaguugaaauaacaccaaauaguccuagagcagaagcaacauuagguggauuuggaucauugggauuagauugugaacccagaacaggucuggauuuuucagauuuauauuaccuuaccaugaacaauaaacauuggcuagugcauaaagaaugguuccacgacauaccacuaccuuggcaugcaggagcagauacaggaacaccacauuggaauaauaaagaggcuuuaguugaauuuaaagacgcacaugcuaaaagacaaacaguaguaguauuaggaagucaagaaggagcaguacauacagcacuagcuggugcauuagaagcagaaauggacggugcaaaagguagauuaucaucaggacacuuaaaauguagauuaaaaauggauaaacuacgccuaaaagguguaucauauucucuauguacagcagcauuuacauucacaaaaauuccugcagaaacauuacaugguacaguaacaguagaaguacaguaugcaggaacggauggacccuguaaaguaccagcacaaauggcaguagauaugcaaacauuaacaccagucggaagauuaauuacugccaacccaguaauuacagaaaguacagaaaacagcaaaaugauguuagaacuagacccacccuuuggagacucuuauauaguaauagguguaggagaaaagaaaauaacacaucauuggcaucguagugguagcacaauaggaaaagcguucgaagcaacaguaagaggagcaaaaagaauggcuguauuaggugauacagcuugggauuucggauccguaggaggagcacucaacaguuuaggaaaagguauucaccaaaucuuuggagcagcauuuaaaaguuuauuuggaggaaugagcugguuuagucaaauauuaauugguacucuauuaaugugguuaggauuaaauacuaaaaauggaucaauaagucuaaugugccuagcauuaggcgguguacuaauauuucugucuacagcgguuucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4877 - RNA, 2284 nt, Artificial Sequence
  KY003156.1 prME-short mRNA Design 1 opt
gggagaaagcuuaccaugacaucaguugggauugugggucuucuuuuaacaacagcuauggcagcagaaguaacaagaagaggaucagcauacuacauguauuuagaucgaaaugaugcuggagaagcaauaaguuuuccaacuacuuuaggaaugaauaaauguuauauacaaauuauggauuuaggacauaugugugaugcuacuaugagcuaugaauguccaaugcuagaugaaggaguagaacccgacgauguagauugcugguguaacacuacaagcacguggguuguauauggaacuugccaccauaagaaaggagaagcuagaagaaguagacgagcaguaacacuaccuagucauucaacgagaaaacuacaaaccagaucacaaacauggcuagaaucaagagaauauacaaaacaccucauaagaguugaaaacuggauauuuaggaacccaggauuugcucuagcagcagcugcaaucgcaugguuauuaggauccucaacaucacaaaaaguuauauacuuaguaaugauuuuauuaauagcaccagcuuauuccauuagauguauagguauaagcaacagggacuuuguagaaggaaugaguggaggaacuugggucgauguagucuuagaacacggcggaugcguaacuguaauggcacaggauaaaccaacuguagauauagaauuaguaaccacaacuguaucuaauauggcugaaguaagaucauacugcuaugaagcaaguauaucugauauggcaucagacucaagaugcccaacacaaggagaagccuauuuagacaaacaaagugauacacaauacguauguaaaaggacauuaguagauagaggauggggaaauggcugcggauuauuugguaaaggaagucuaguaacuugugccaaauucgccuguucaaagaaaaugacaggaaaaucaauucaacccgaaaaucucgaauaucguauaauguugucaguacacggaucacaacauaguggaaugauaguuaacgacacuggccacgaaacggacgaaaaucgagcaaaaguagaaauaacaccaaauaguccuagagcagaagcgacauuaggaggauuuggcauauuaggauuagauugugaaccaagaacuggacucgauuuuucagauuuauacuauuugacaaugaauaauaaacacugguuaguacacaaagaaugguuucaugacauaccuuuaccguggcaugcaggagcagacacaggaacgccucacuggaacaauaaagaagcauuaguggaguucaaagaugcacacgcaaaaagacaaacaguaguaguauuagguagucaagaaggagcaguacauaccgcacuagcuggcgcuuuagaagcagaaauggauggcgcaaaaggaagauuaucaagcggacauuuaaaauguaggcuaaaaauggauaaacuaagauuaaaaggaguaagcuauagcuuaugcacagcagcauucacauuuacaaaaauaccagcagagacauuacaugguacaguuacuguagaaguccaauaugcagguacugauggaccauguaaaguaccggcacaaauggcaguagacaugcaaacauuaacaccuguugguagacuaaucacagcaaauccuguaauaacagaaucaacagaaaacucgaaaaugauguuagaauuggacccuccauuuggagacucauauauugucauaggaguaggagaaaagaaaauaacucaucauuggcauagaucaggaucaacaauaggaaaagcauuugaagcaacagugagaggagccaaaagaauggcgguucuuggagacacagcuugggauuuuggaucuguaggaggagcauuaaauaguuuaggaaaaggaauacaucaaauauuuggcgccgcuuuuaaaagccuuuuuggaggaaugucaugguuuagucaaauacugauagguacgcuauuaauguggcuugguuugaauacgaaaaauggaaguauaaguuuaaugugucuggcacuuggagggguauuaauauucuuaucaacagcagugucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4878 - RNA, 2284 nt, Artificial Sequence
  KU312313.1 prME-short mRNA Design 1 opt
gggagaaagcuuaccaugaccaguguagggauaguaggauuacuauuaacuaccgcaauggccgccgaaguaacaagaagaggcagugcauauuacauguacuuagacaggaaugacgccggugaagcuauaaguuuuccaacaacuuuaggaaugaauaagugcuauauucaaauaauggacuuaggacauacgugugaugcaacaaugucauaugaauguccgauguuggacgaaggaguagaaccagaugauguagauuguugguguaacacaacgaguacauggguuguauauggaacuugucaucacaagaaaggagaagcaagaagaagcagacgagcaguaacccuucccucucacaguauaagaaaacuacaaacaaggagccaaacauggcuagaaaguagagaauauacaaaacaucugauuagaguugaaaauuggauauucagaaauccuggauuugcguuagcagcggcagcaauagcaugguuauuagguaguucaacaagucaaaaaguaauuuaccuaguaaugauauuacuaauugcaccagcauacucuauaaggugcaucggaguaucaaauagagauuucguagaagguaugucaggaggaacauggguagacguaguguuagaacaugguggauguguaacuguaauggcgcaagauaaaccaacaguggauauagaacugguaacaacuacuguaagcaauauggcagaaguacgaucguauuguuaugaggccaguauaucugauauggccagugacaguagaugcccaacacaaggugaagcauaccuagacaaacaaucagacacucaguauguuuguaaacgaacauuaguagaucgagguugggguaauggauguggguuauucggaaaaggaaguuuaguaacuugugcaaaauuugcauguucaaagaaaaugacaggaaaaucaauacaaccagaaaaucuagaauauagaauaauguuaucuguacaugguagccaacacagcggaaugauuguuaacgacacaggacaugaaacggaugaaaauagagcgaaaguugaaauaaccccaaauagcccaagagcagaagcaacuuuagguggauuuggaucauuagguuuagauugugaaccaagaaccggacuagacuuuagugaccuauauuauuuaacaaugaauaauaaacauugguuaguacauaaagaaugguuucacgauauaccacucccauggcacgccggagcagauacagguacaccacacuggaauaauaaagaagcauuaguagaguucaaagaugcgcacgcaaaaagacaaacuguugugguucuaggaagucaagaaggcgcaguucauacugcauuagcgggagcacuagaggccgaaauggacggagcaaaaggaagacuuagcucaggucaucuaaaaugcagauuaaaaauggauaaacuccgauuaaaaggaguaucauacaguuuauguacagcagcauuuacauuuacaaaaauaccagcagaaacucuacauggaacugugacaguagaaguacaauacgcggguacugacggaccuuguaaaguaccagcucaaauggccguggauaugcaaacauuaacaccaguuggaagauuaauuacagcuaacccaguaauaacugaaucaacagaaaacagcaaaaugauguuagaauuagacccgccauuuggagacaguuauauaguaauuggaguaggcgaaaagaaaauaacucaucacuggcaccgaucaggaucaacaauagguaaagcauuugaagcaacuguucgaggagcaaaaaggauggcaguacuaggcgauacagcgugggauuuuggaucuguaggaggugccuuaaauucuuuaggaaaagguauacaccaaauuuuuggagcagcauuuaaaucacuauuugguggaaugagcugguucucacaaauauuaauaggaacacuauuaauguggcuuggucuaaaugcuaaaaaugguaguauaaguuuaauguguuuagcauuaggaggaguacuaaucuuccuaagcaccgcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4879 - RNA, 2284 nt, Artificial Sequence
  KY075935.1 prME-short mRNA Design 1 opt
gggagaaagcuuaccaugacauccguagguauaguaggauuacuacuaacaacagccauggccgcagaaguaacccgucgaggaucugcauacuauauguauuuagaccgaaacgacgcaggagaagcuauauccuucccaacaacucuaggaaugaauaaauguuauauucaaauaauggauuuaggacauaugugcgaugcaaccaugucauaugaauguccaauguuagaugaagggguagaaccagaugauguagacugcugguguaauacaacuuccacauggguuguauacggaacgugucaucauaagaaaggagaagcgcaaagaaguagacgagcaguuacacuaccaagucauaguacaagaaaauuacaaaccagaucucaaacauggcuagaaucaagggaauacacuaaacaucuaauaagaguagaaaauuggauuuuuagaaauccuggauuugcacuagcggcagccgcaauagcauggcuauuaggaaguucuacaucacaaaaaguaauauacuuaguaaugauacuauuaauagcaccagcuuacaguaucagaugcauaggaguuucaaacagagauuucguagaaggcaugaguggaggaacauggguugauguaguacuagaacaugguggaugcguaacaguaauggcacaagacaaaccaacaguagauauugaauuaguaacaacaaccguaucaaauauggcugaagucagaaguuacuguuaugaagcuagcauaagugauauggcaagugauucaaggugcccaacacaaggugaggcuuaucuagacaaacaaagugacacacaauauguauguaaaagaacuuuaguagaccgaggauggggaaauggauguggauuauucggaaaaggauccuuaguaacuugcgcuaaauuugcguguucaaagaaaaugacagguaaaaguauacaaccagaaaauuuagaauauagaauaaugcuaucaguacacggaagccaacauucaggcaugauaguaaacgauaccggacaugaaaccgacgaaaacagagcaaaaguugaaauuacacccaacagcccccgagcagaagcaacccuuggagguuuuggcagcuuaggauuagauugugaaccaagaaccggauuagauuuuagugaccuauauuaucuaacaaugaauaauaaacauugguuaguacacaaagaaugguuucacgacauaccauuaccauggcaugcaggagcagacacuggaacaccacauuggaauaauaaagaagcauuaguagaauuuaaagaugcucaugcaaaacgacaaacaguaguaguauuaggcagucaagaaggggccguacauacagccuuagcaggggcacucgaagcagaaauggacggagcuaaaggaagacuaucaaguggucauuuaaaaugucgcuuaaagauggauaaauugagauuaaaaggaguaaguuauucacuauguacagcugcauuuacauucacaaaaauaccagcagaaacacuucauggaaccguaacaguagaaguacaauaugcagggacagauggaccauguaaaguaccugcacaaauggcaguugauaugcaaaccuuaacaccaguaggaagacuaauaacagcaaauccaguaauaacagaaucgacagaaaauaguaaaaugauguuagaauuagacccacccuuuggagacucauauauagugauagguguaggugaaaagaaaauaacucaccauuggcauagauccggaaguacaauaggaaaagcauuugaagcaacaguaagaggagcgaaacguauggcuguacuaggagauacagcaugggauuuuggaucaguaggaggagcacuaaauagccuuggaaaaggaauacaccagauauuuggagcagcauuuaaaucuuuauuuggaggaaugucaugguucagucaaauauuaauagguacauuacuaaugugguuagguuuaaacacuaaaaauggaucuauaucuuuaauguguuuagcauuagggggaguuuuaauauuucuaucaacagcuguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4880 - RNA, 2284 nt, Artificial Sequence
  KY014320.1 prME-short mRNA Design 1 opt
gggagaaagcuuaccaugacuuccguagguauaguagguuuacuauuaacaacugccauggccgcagaaguaacuagaagagguagcgcauauuauauguacuuagaucgaaacgaugccggagaagcaauaucauucccaacaacauuaggcaugaauaaauguuauauacaaauaauggauuuaggacauaugugugaugcaacaaugucauacgaauguccgaugcuagacgaagguguagaaccagacgauguagacuguugguguaacacaacuuccacauggguuguuuauggaacuugucaucauaaaaaaggagaagcaagacguucacguagagcuguaacccuaccaucacauucaacaagaaaacuucaagcaagaucacaaacauggcuagagucuagagaauacacaaaacauuuaauaagaguagaaaacuggauauuuagaaauccgggauucgcuuuagcugcagcagcaaucgccuggcuauuagguucaagcacaagucaaaaaguaauauacuuagucaugauauuauugauagccccagcuuauucaauaagauguauaggaguuucaaacagggauuuugucgaaggaaugucaggaggaacauggguagaugucguauuagaacacggaggauguguaacaguaauggcacaagauaaaccaacaguugacaucgaauuaguuacaacgacaguaagcaauauggcugaaguaagaucuuauuguuaugaagcaagcauuagugacauggcaagugauucaaggugcccaacacaaggagaagcuuauuuagacaaacaauccgauacucaauacguauguaaaagaacauuaguggauagaggauggggcaauggauguggccuauuugguaaaggaaguuuaguaacuugugcaaaauuugcauguaguaaaaaaaugacagguaagagcauacaaccagaaaaucuagaauaucgaauaauguuaucuguucauggcagucaacacucaggaaugauaguaaaugacacaggacaugaaacugaugagaauagagcaaagguagaaauaacaccaaacagcccaagagcugaagcaacauuaggaggguuuggaucauuaggacucgauugugaaccaaggacuggcuuagacuuuucagauuuauauuauuuaacaaugaauaauaaacauuggcuaguacacaaagaaugguuucaugauauuccgcuaccauggcacgcaggagcagauacgggaacuccccauuggaauaauaaagaagccuuaguagaguucaaagacgcacacgcaaaaagacaaacagucguaguacuuggaagucaagaaggagcaguacauacagcuuuagcaggggcucuugaagcagagauggacggagcaaaaggaagacugucaagcggacaucuaaaaugcagauuaaaaauggauaaacuaagauuaaaaggaguaucuuacagucuuugcaccgcugcuuuuaccuuuacaaaaauaccagcagaaacuuuacauggaacuguuaccguagaaguccaguacgcuggaacagauggcccaugcaaaguacccgcacagauggcuguagauaugcaaacauuaacaccaguagguaggcugauaacagcaaaucccguaauaacagaaucaacagaaaauucaaaaaugaugcuagaacuugacccaccuuuuggcgauaguuauauaguuauaggaguaggagaaaaaaaaauaacacaucauuggcacagaucugguuccacgaucggaaaagccuuugaagcaacaguaaggggagcgaaaagaauggcuguacuaggugacacagccugggauuucggaucaguuggaggugcacuaaauucauuaggaaaaggaauacaccaaauuuuuggagcagcauuuaaaucauuauucggcggaaugagcugguuuucacagauuuuaauaggaacacuauuaauguggcuaggacuaaauacaaaaaauggaucgauaagucuaaugugucuagcacuaggaggaguauugauauuucuaucaacggcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4881 - RNA, 2284 nt, Artificial Sequence
  KY328290.1 prME-short mRNA Design 1 opt
gggagaaagcuuaccaugacaucaguaggcauaguaggacuauuacuaacaacagccauggcagcggaaguaacaaggagaggaucugcauauuacauguacuuagaucgauccgaugcaggagaagcaauaaguuuuccaacaacuuuagguaugaauaaauguuauauacaaauaauggauuuaggacacaugugugaugcuacuaugucuuaugaaugcccaauguuagacgaaggaguggaaccugaugauguugauuguugguguaauacaacaaguacauggguaguauaugguacaugucaucauaagaaaggagaagcgaggagaucaaggagagcuguaacauuaccaagucauagcacaagaaaauuacaaacaagaagccaaacuugguuagaaaguagagaauacacaaagcauuuaauaagaguagaaaauuggauauuuagaaacccaggauuugcacuagcagcagcagcaauagcauggcuauuaggcaguaguaccucacaaaaagucauauauuuaguuaugauacuuuuaauagccccugcauauagcauuagauguauaggcguuagcaaucgagauuuuguagaagguaugucaggagguacuuggguagauguaguauuagaacacgggggaugugucaccguaauggcccaagacaaaccaacuguagauauagaguuaguuacuacaacaguaagcaauauggcagaagucagaaguuauugcuacgaagcaagcauaagcgauauggcuagugauagccgauguccuacccaaggagaggcguauuuagauaaacaaucugacacgcaauauguauguaaaagaacucuaguagacagaggauggggcaacggaugcggauuauuuggaaaagguagcuuaguaacaugugcaaaauuugcauguucaaagaaaaugacuggaaaaaguauucaaccagaaaacuuagaauaucgaauaaugcuaucaguacauggaagucaacauucaggaaugauaguaaacgacacuggacacgagacagaugaaaaucgagcgaaaguagaaauaacaccaaauucaccuagagcugaagcaacauuagguggauuugguagcuuaggauuagauugugaaccaagaaccggucuagauuucagcgaccuauauuauuuaacaaugaauaauaaacacuggcuaguacauaaagaaugguuucaugauauuccucuaccuuggcacgcuggagccgacacuggaacaccucauuggaacaauaaagaagcguuagucgaguucaaagaugcccacgcaaaaagacaaacuguaguaguauuaggaucacaagaaggagcaguacauacagcacuagcaggagcacuagaagcagaaauggauggagcaaagggaagauuaagcaguggacaccuaaaauguagacuaaaaauggacaaacuaagauuaaaaggaguuucuuauagucuaugcacggcagcuuucacauuuaguaaaauuccagcugaaacauuacauggcacaguaacagaagaaguccaauaugcagguacugauggaccauguaaaguaccagcacaaauggcaguagauaugcagacacuaacacccguagguaggcuuauaacagcgaauccaguaauaacugaaaguacugaaaauaguaaaaugauguuagaauuagaucccccauuuggugauucauacauaguaauaggaguaggagaaaagaaaauuacacaucauuggcaccguucaggaucaacaaucggaaaagccuuugaagcaacuguuagaggagcaaaacgaauggcaguuuuaggagauacugcaugggauuucggaaguguaggaggggcauugaauagcuugggaaaagguauucaucaaauauucggagcagcauuuaaaagucuauuuggugguaugaguugguuuagucaaauacuaauuggaacauuacuaauguggcuagguuuaaauacgaaaaacggaucaaucaguuuaaugugccuagcucuaggcggcguccuaauauuuuugaguacagcaguuuccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4882 - RNA, 2284 nt, Artificial Sequence
  KU681081.3 prME-short mRNA Design 1 opt
gggagaaagcuuaccaugacaucuguaggaauaguaggacuacuacuaacuacagccauggcugcagagguaacaagaagaggaucagcauauuauauguauuuggauaggucagaugccggugaagcaauaaguuuuccuacuacauuaggaaugaacaaauguuauauacaaauaauggauuuaggacauaugugugaugcaacaaugaguuaugaaugcccgaugcuagaugaaggagucgaaccagaugaugucgauuguuggugcaacacaacaucaacguggguugucuauggaacaugucaccacaagaaaggugaagcuagaagaucaaggagagcaguuacauugcccagucauaguacaagaaaauuacaaacaagaagucaaacaugguuagaaaguagagaauauacuaaacaucuaauacguguggaaaauuggauauuuagaaauccaggauuugcgcuagcagcagcagcaauagcaugguuacuagguucuaguacaagucaaaaaguaauauaucuagugaugauauuauuaauugcacccgcauauaguauaaggugcauaggugucagcaauagagauuuuguggaaggaaugucuggaggaaccuggguugauguaguuuuagaacaugggggaugcguuacaguaauggcacaggauaaacccacaguugauaucgaauugguuacgacaacaguuaguaacauggcagaaguaagaucauacuguuaugaagcaaguauaucagauauggcaucagauucaagauguccaacccaaggagaagcauauuuagacaaacaaagugauacccaauacguauguaaacgaacucuuguagauagaggauggggaaacggauguggauuauuuggaaaagguagucuaguaacuugcgcaaaauuugcuuguucaaagaaaaugaccggaaaaucaauacaaccagaaaacuuagaauauagaauuaugcuaaguguacauggaucucagcacagcgggaugauaguuaacgacacaggucaugaaacagacgaaaauagagcaaaaguagaaauaacaccaaacaguccaagagcagaagcaacccuugguggauuugggaguuuaggucuggauugcgaaccgagaacaggauuagauuuuagugauuuauauuaucuaacaaugaauaauaaacauugguuaguacauaaagaaugguuccaugauauaccacuuccauggcauacgggagcagacaccggaaccccacauuggaacaauaaagaggcauuaguugaauuuaaagacgcacacgcaaaaagacaaacaguaguaguacugggcucccaagaaggagcaguacauacagcacuagcgggugcacucgaagcagaaauggauggagcgaaaggaagauuaagcaguggccaucuaaaauguagguugaaaauggacaaacuaagguuaaaaggaguaaguuacagccucuguacagcugcuuucaccuuuacaaaaauaccggcagaaacauuacacggaacaguaacaguagagguucaauaugcaggaacagauggaccauguaagguuccagcacaaauggcagucgauaugcaaacauuaacuccaguuggaagauuaauaacagcaaauccuguuauaacagaaggaacagaaaacucaaaaaugauguuagaacuagauccaccauuuggcgauaguuauaucguaauaggaguaggggaaaagaaaauaacucaucacuggcauagaagcggaucaaccauagguaaagcauuugaagcaacgguaaggggugcaaaaagaauggcaguauugggagacacagcuugggacuuuggaaguguaggagguguauuaaacagucuaggaaaaggaauacaucaaauauuuggagcagcauuuaaaaguuuauuuggaggaaugagcugguuuucacaaauauuaauaggaacauuacuuaugugguugggacuaaauacuaaaaauggaucgauaagccugauguguuuagcacuagguggaguuuuaaucuuccuaaguacagcaguaagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4883 - RNA, 2284 nt, Artificial Sequence
  KX827309.1 prME-short mRNA Design 1 opt
gggagaaagcuuaccaugacaucaguaggaauaguaggauuacuacuaaccacagcaauggcagcagagguaacaaggagaggaucagcauauuauauguauuuagaucgaucagacgcaggagaagcaauaaguuuuccaaccacgcuaggcaugaauaaauguuacauucaaauaauggacuuaggucauaugugugaugcaacaauguccuaugaauguccuauguuagaugaaggaguugaaccugaugauguugauuguugguguaacacaacaucaacuuggguaguauaugguacaugucaccauaaaaaaggagaagcuagacgaaguagaagagcuguaacacuaccaagccacucgacuagaaaacuacaaacaagaucacaaacaugguuagaaaguagagaauacacaaaacaucuuauacgaguagagaauuggauauuucgcaauccaggauuugcacuagcagcagcagcaauagcgugguuauuagguucaucuacaagccaaaaaguaauauauuuaguaaugauauuauuaauagcaccagcguauucaauaagauguauaggagucaguaauagggauuucguagaaggaaugucuggcggaacauggguagauguaguacuagaacauggaggaugcguaacaguaauggcucaagauaaaccaacuguugauauagaauuaguaacaacaacaguaagcaauauggcagaaguaagaucauacuguuaugaggcaaguauaagugauauggcaucagauagcagaugucccacacaaggcgaagcauaucucgacaaacaaagcgacacgcaauauguauguaaacgaacucuaguagauagagguugggguaacggcuguggacuauuuggaaaaggaaguuuaguaaccugcgcuaaauucgcauguucaaaaaaaaugacgggaaaaucaauacaaccagaaaacuuagaauauagaauaauguuaagcguacauggcagucaacacucaggaaugauaguaaaugauacaggucaugagacugacgaaaaccgagccaaaguagaaauaacuccaaauucaccaagagcugaagcaacacuuggagguuuuggcaguuuagguuuagacugugaaccaagaacaggacuagacuuuuccgaucuauauuaccuaacaaugaacaauaaacauugguuaguacauaaagaaugguuucaugacauaccauuaccuuggcaugcaggagcagauaccggaacaccucacuggaauaauaaagaagcacuaguugaauucaaagaugcacaugcuaaaagacaaacugucguuguacuagguagucaagaaggagcaguucauaccgcacuagcgggagcacuugaagcagaaauggacggggcaaaaggaagauuaagcucaggacauuuaaaaugcagacuaaaaauggauaaacuaagacuaaaaggagucucauauaguuuauguacagcagcguuuacauuuacaaagauuccagcagaaacauuacauggaacaguaacuguagaaguacaguaugcaggaacugacggaccauguaaaguuccagcacaaauggcuguugauaugcaaacuuuaacuccaguaggaagauugauuacagcaaaucccgugauaacagaauccacagaaaauucuaaaaugauguuagaacucgaucccccguuuggagauagcuauauaguaauaggaguaggagaaaaaaaaauaacacaccauuggcacaggucagguuccacaauagguaaagcuuuugaagcuacaguaagaggagcuaaaagaauggcuguacuaggagauacagcaugggauuuuggaagcguaggcggagcacuuaauucauuaggaaaagguauccaccaaauauucggagccgcuuucaaaucuuuauuuggaggaaugaguugguuuagccaaauauuaauaggcacucuacuaaugugguuaggacuaaacacuaaaaauggaucuauaucauuaauguguuuagcauuaggcggaguucuaauuuuucucucaacagcaguaucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4884 - RNA, 2284 nt, Artificial Sequence
  KU955593.1 prME-short mRNA Design 1 opt
gggagaaagcuuaccaugacaucaguaggaauaguuggauuauuauuaacaacagcaauggcaguagaaguaacuagaagaggaaaugcauauuacauguacuuagaucgaucagaugccggugaagcgauuagcuuuccaacaaccaugggaaugaacaaaugcuacauacaaauaauggaccuaggccauaugugcgacgcuacaaugucauacgaauguccuauguuagaugagggaguagaaccugaugauguugacuguugguguaauacaacaaguacuuggguaguauauggaacaugccaucauaagaaaggagaagcaaggagaucaagacgagcaguaacacuuccaagccauucaacuagaaaacuucaaacaagaucucaaacguggcuagaaucaagagaauauacaaaacacuuaauaagaguagaaaauuggauuuuccgaaauccaggcuuugcauuagcagcagcugcaauagcuugguugcuaggaaguucaacaucacaaaaaguaauuuaccucguaaugauauuauuaauagcacccgcauacucaauucgaugcauaggaguaaguaacagagacuuugucgaagguaugucaggagggacuuggguagauguaguacuagaacauggagguugcguaacaguaauggcucaagauaaaccaacaguagacauagaauuagucacuacaacgguaucaaacauggccgaaguacgaucauauuguuaugaagcaucaauaucagacauggccagugacuccagauguccaacacaaggugaagccuaucuagauaaacaaagugauacgcaauauguauguaaacgaacacuuguagacagagguuggggaaacggcugcgguuuauuugguaaaggaaguuuaguaacaugugccaaauuugcauguuccaagaaaaugacagguaaaagcauacaacccgaaaauuuggaauaucgaauuauguuaucaguacacggaucacaacacucagguaugauagucaaugauacuggucacgaaacugaugaaaauagagcaaaagucgaaauuacacccaauucgccuagagcugaagcaacguuaggaggauuuggcucauuaggauuagauugcgaaccaagaacaggucucgauuucucagacuuauauuacuuaaccaugaauaauaaacauuggcucguucacaaagaaugguuucaugauauaccucuacccuggcaugcaggagcagauaccgguacaccacauuggaauaacaaagaagcgcuaguagaauuuaaagacgcacaugcaaaacgacaaacuguaguaguuuuaggaucacaagaaggagcaguacauacugcauuagcuggagcauuagaagcagaaauggauggagcaaaaggaagguuaaguaguggucauuuaaaauguagauuaaaaauggauaaguuaagacuaaaaggagugaguuauucacuaugcacagccgccuuuacauuuacuaaaauuccagcagaaacauugcauggaacagucacaguggaaguacaauacgccggaacagacggaccaugcaaagucccagcacaaauggcaguagauaugcaaacauuaaccccaguaggaagacuaauaacagcaaauccuguaauaacugaaucaacggaaaauucaaaaaugauguuggaauuagauccaccauuuggcgauucauauauaguuauaggcgucggagaaaagaaaauaacccaucauuggcacagaucagguucaacaauaggaaaagcauuugaggccacgguaagaggcgcaaaaagaauggcaguauuaggagacacagcaugggauuucggaagcguuggaggagcacucaauagcuuagguaaaggaauccaucaaauuuuuggagcagcguucaaaucauuauuugguggaaugucaugguuuucacaaauauuaauaggaacuuuauuaguaugguuaggacuaaauacuaaaaacggaucuauaagccuaauguguuuagcacucggaggaguauuaauuuuccuaaguacagcaguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4885 - RNA, 2284 nt, Artificial Sequence
  KY272987.1 prME-short mRNA Design 1 opt
gggagaaagcuuaccaugacaucaguaggaauaguuggucuauuauugaccacagcaauggcugccgaagugacaagaagagguucagcauauuauauguaucuugaucggucugaugcaggagaagcgauaaguuuuccaacaacucuaggaaugaacaaauguuauauacaaauaauggaccuagggcauaugugugacgcaacaaugaguuaugaauguccaaugcuagaugaaggaguagaaccagacgauguugacuguugguguaauaccaccaguacauggguaguauauggcacaugucaucauaaaaaaggagaagcgcgacguaguagacgcgccguaacacucccaucacauucaacaagaaaacuucaaacaagaagccaaaccugguuagaaaguagagaauacacaaaacaccuuauaagaguagaaaacuggauauuuagaaauccaggcuucgcauuagcagcugcagcaaucgcaugguuacucggaucaucaacaucccaaaaaguaauauaucuagugaugauacuauuaaucgcaccagcauacucaauaagauguauaggaguaaguaacagagauuuuguugaagguaugaguggggggacauggguagauguaguacuagaacauggcggaugcguaacagucauggcucaagauaaacccacaguagauauagaacucguaacaacaacaguaucaaacauggcagaagucagaucauauuguuaugaggcaaguauaagugacauggcaucagacaguagguguccaacccaaggagaagcuuaucuagacaaacaaagugauacccaauauguauguaaaagaacuuuaguagacagaggauggggaaauggaugcggauuauuuggaaaagguucguuaguaacgugcgcaaaauucgcauguagcaaaaaaaugacugguaaaucaauacaaccagaaaaucuagaauacagaauaaugcucucugugcacgguagucaacauucuggaaugauaguaaaugauacaggacaugaaacggaugagaacagagcaaaaguagaaauaacaccaaacaguccaagagcagaagcaacacuaggggguuucgguucuuuaggauuagauugugaaccaagaacaggacuagauuuuagcgaucuauauuauuuaacaaugaacaacaaacauugguuaguacauaaagaaugguuucaugauauaccacucccauggcaugcaggcgccgauacaggcacaccacauuggaauaacaaagaagcacuaguggaauuuaaagaugcacacgccaaaagacaaacuguaguaguacuaggaucacaagaaggagcuguacauacagcauuagcaggugcacuagaggcagaaauggauggagcaaaaggaagauuaucuagcggccaucuaaaaugcaggcuaaaaauggauaaauuaagacuaaaaggagugucauacucucucuguacugcagcauucacuuuuacaaaaauacccgcagaaacguuacacggaacuguaacagucgaaguucaauaugcaggaacagauggaccauguaaaguaccagcacaaauggcaguagauaugcaaacuuuaacuccaguuggccgacuaauuacagcaaauccaguuauuacagagucaacagaaaauagcaaaaugaugcuagaauuagacccaccauucggagauucauauauagucauaggggucggagaaaaaaaaauuacgcaucacuggcacagaagcggaucaacaauaggaaaagcuuucgaagcgacaguaagaggagcaaaaagaauggcaguuuuaggggauacagcaugggacuuuggauccgucgguggagcacuaaauagucuaggaaaaggaauacaucaaauauucggagcggccuuuaaaucgcuauuuggaggcaugucaugguuuagucaaauucuuauagguacuuuacuaaugugguuaggguuaaauacgaaaaacgggucaauaaguuuaguauguuuagcucuaggaggagugcucauauuccuaucaacagcgguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4886 - RNA, 2284 nt, Artificial Sequence
  KY007221.1 prME-short mRNA Design 1 opt
gggagaaagcuuaccaugacaaguguaggaauuguaggauuauuacugacaacugcuauggcagcagagguuacaagaagaggaagcgcauauuauauguaucuagauagaucagaugcuggugaagcaauuucuuuuccaacaacauuaggaaugaauaaauguuacauacaaauuauggauuuaggacauaugugugacgcuaccaugaguuaugaauguccaauguuagaugaaggaguugaaccagaugacguagauuguugguguaauacaacaucaacauggguaguauaugggacaugccaucauaagaaaggagaagcaagacgaaguagacgagcuguaacauugccaucacauucaacaagaaaauugcaaacuagaucacaaacuuggcuagaaaguagagaauauacaaaacauuuaauccgaguagagaauuggauauuccgaaauccuggauuugcauuagcagcagcagcaauagcguggcuucucgguaguucaacaucacaaaaaguuauauacuuggucaugauauuauuaauagcuccggcauauagcaucagauguaucggaguaaauaaucgagauuucguagaaggaaugucagguggaacguggguagauguaguauuagaacacgguggauguguaacuguaauggcacaagauaaaccaacuguugauauagaacucguaacaacgacaguaaguaauauggcggaaguacgaaguuauuguuaugaagcauccauaucugauauggcaucagacagcagauguccaacccaaggagaagcauaccuggauaaacaaucagauacgcaauauguauguaaaagaacuuuaguugacagaggauggggaaauggaugcggcuuauucggcaaaggaaguuuaguaacaugcgcaaaauuugcguguaguaagaaaaugacaggaaaaagcauacagccagaaaaccuagaauauaggauaauguugaguguacauggcagucaacauaguggaaugauagucaaugauacuggccacgaaacagaugaaaauagggcaaaaguagaaaucacaccaaauagcccucgagcagaagcaacauuaggaggauuuggaucuuuaggucuagauugugaaccaagaacaggcuuagauuuuucagacuuauacuaucuuacaaugaauaacaaacauuggcuaguacauaaagaaugguuucacgauauaccacuaccuuggcaugcaggagcagacacuggaacaccacauuggaauaacaaagaagcacucguagaauuuaaagacgcacaugcaaaaagacagacagugguaguuuuaggaucacaagagggagcaguacauaccgcauuagcaggagcucucgaagcugaaauggauggagcaaaaggaagauuaucaagcggacauuuaaaaugcagacuaaaaauggacaaauuaagauuaaaagguguaaguuacagucuauguacugcagcauuuacauucacuaaaauaccagcggaaaccuuacauggaacgguaacaguagaagugcaguacgcugguacggauggacccuguaaagucccugcacaaauggccguagauaugcaaacucuaacaccuguaggacgacuaauuacagcuaauccaguaauaaccgaaagcacagaaaacucuaaaaugauguuagaauuagauccuccuuuuggagauucauacauuguuauaggaguaggcgaaaagaaaaucacacaccauuggcauagauccggaaguacaauaggaaaagcauuugaggccacaguaagaggcgcaaaaagaauggcaguacuaggagacacagccugggauuuugguucuguaggaggagcauuaaacaguuuaggcaaaggaauacaucagauuuucggagcagcauuuaaaucauuauucgggggaaugaguugguuuucacaaauacuuauaggaacacuacuaauguggcuggguuuaaauacuaaaaauggaagcauaucccuaguuugccuagcacuaggaggaguucugauauuucuaucaacagcuguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4887 - RNA, 2284 nt, Artificial Sequence
  EU545988.1 prME-short mRNA Design 1 opt
gggagaaagcuuaccaugacgucaguaggaauaguaggguuacuuuuaacgacagcaauggcaguagaaguaacacgaagaggauccgcauauuacauguaucuugaccgaucagaugcaggagaagcaauaaguuucccaacaacacuaggaaugaauaaaugcuauauacaaauaauggauuuaggucacaugugcgaugcaacaauguccuaugaauguccgauguuagaugaagguguggaaccugaugauguagauuguugguguaauacuacaucuacauggguugucuacggcacaugucaucauaagaaaggagaagcgcgaaggaguaggagagcaguaacacuaccgucacacagcacaagaaaauuacaaacuagaucacaaaccugguuggaauccagagaauauacaaaacauuuaaucagaguagaaaauuggauauuuagaaauccaggguuugcuuuagcagcagcagcaauagcaugguuauuaggaaguucaacuagccaaaaaguuaucuaccuaguaaugauucuauuaauagcaccagcguauucaauaagauguauagggguaaguaauagagacuucguagaaggaaugaguggaggaacuuggguagacgugguauuagaacauggaggaugcguaacagugauggcacaagacaaaccagcaguagacauagaauuaguaacaacaacaguaagcaauauggcagaaguaagauccuauuguuaugaagcaucaauaucagauauggcaagcgacucgagauguccgacacaaggagaggcuuaucuagacaaacaaagcgauacccaauauguaugcaaaagaacauuaguagauagaggaugggguaaugguugcggauuauucggaaaaggaucucuagucacaugugcuaaauucgcauguucaaagaaaaugacaggcaaaaguauacaaccagaaaauuuagaauacagaauaauguuaagcguucauggaagucaacauaguggaaugauaguaaacgauacgggacacgaaacggaugaaaauagagcgaaaguggaaauaacaccuaauucaccaagagcagaagcuacacuagguggauuuggaucucuaggacuggacugugaacccaggacaggucuagauuuuagcgaccuauauuacuuaacgaugaauaauaaacauuggcuaguucauaaagaaugguuucaugacauaccauuaccauggcaugcuggagccgacacagguacaccacauuggaauaauaaagaagcauuaguagaguucaaagaugcucaugccaaaaggcagacaguuguuguacuagggucacaagaaggagcaguacauacagcucuagcgggagcacuagaagcagaaauggauggagcaaaagggcgauuaagcucuggacauuuaaaauguagauuaaaaauggauaaauuaagauuaaaaggaguaaguuauucauuaugcacagcggccuuuacauucacaaaaauaccagcagaaacacuacaugggacagugacaguagaaguucaauaugcaggaacagacggaccuugcaaaguuccggcacaaauggcaguugauaugcaaacacuaacaccagugggaagauuaauaacagcaaacccaguuauaacagaaaguacagaaaauagcaaaaugaugcuggaauuagauccaccauuuggugacaguuacauaguuauaggagugggagaaaagaaaauaacacaucauuggcauagaucugggagcacaauuggaaaagcguucgaagccacaguaaggggugcaaaaagaauggcaguauuaggagauacugcaugggauuuuggaucaguagggggugcuuuaaauucauuaggaaaaggaauacaucaaauuuucggugcagcauuuaaaaguuuauuuggaggaaugucaugguucagucaaauccucauuggaaccuuauuagucuggcugggauuaaauacuaaaaacgguucuauaaguuuaaccugucuagcacuaggaggcguauuaauuuucuuaagcacagcaguuagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4888 - RNA, 2284 nt, Artificial Sequence
  KU681082.3 prME-short mRNA Design 1 opt
gggagaaagcuuaccaugacgucaguagggauagucggauuauuauuaacaacugcuauggcaguugaaguuacaagaagaggaagugcauacuauauguaucuugauagaucagaugcgggugaagcaauaucauuuccuacuacacuuggaaugaacaaauguuauauacaaauaauggaucuaggacauaugugugaugcaacaaugagcuacgaauguccgauguuagacgaaggaguagagccagacgauguagauuguugguguaacacaacaucaacaugggucguuuauggaacgugucaccacaaaaaaggagaagcaagaagaucgcgaagagcaguuacacuaccaagccauaguaccagaaaacuacaaaccagaucacaaacauggcuagaaucacgugaauauacaaaacaucuaauacgaguugaaaauuggauauuuagaaauccagguuuugcacuagcagcagcaguaauagcauggcuacuaggaucgucaacaagucaaaaagucauauacuuagucaugauccuacuaauagcaccagcuuacuccauaagauguauaggaguaagcaacagggauuuuguugaagguaugaguggcggaacauggguugauguuguacuagaacacggggguuguguaaccguuauggcacaagacaaaccaacaguagacauagaacugguaacaacaacaguaucaaauauggcagaaguucgaaguuauuguuaugaagcaaguauuagcgacauggcuagugauucaagauguccaacacaaggugaagcauauuuagauaaacaaucugauacacaauacgucuguaaaagaacacuugucgacagaggauggggaaauggaugugguuuauuuggaaaaggaagccucguaacuugugcuaaauuugcauguaguaaaaaaaugacgggaaaaaguauacaaccagaaaauuuagaauauagaauaauguuaagugugcacggaucacagcauucagguaugauuguaaacgacacaggacaugagacugacgaaaauagagcaaaaguagaaauaacaccgaacagcccuagagcagaagcaacacuuggagguuuuggaucauuaggucuugauugugaaccuagaacagguuuagauuucagcgacuuauauuaucuaacaaugaacaauaaacauugguuagugcacaaagaaugguuucacgacauaccgcugccauggcaugcaggagcagacacaggaacaccucauuggaauaauaaagaagcgcuaguugaauuuaaagaugcacacgcaaaaagacaaacaguaguuguacuaggaagccaagaaggcgcaguucauacagcguuagcaggagcucuagaggcagagauggauggcgcaaaagggagauuaaguaguggacauuugaaauguagacuaaaaauggauaaauuaagauuaaaaggaguaucauauagccuaugcacagcagccuuuacauuuacaaaaauaccagcagaaacauuacauggaacuguaacuguggaaguacaauaugcaggaacagauggcccauguaaaguaccagcacaaauggcugucgacaugcaaacacuaacaccaguuggaagguugauaacugcaaauccagugauuacagaaucaacagaaaauucaaaaaugauguuagaguuagacccaccauuuggagauagcuacauaguaauuggcguaggagaaaaaaaaauuacgcaucauuggcacagaagcggauccacaauaggaaaagcauuugaagcaacaguaagaggagcaaaaaggauggcaguguuaggagauacagcaugggauuuuggaagugucggaggugcucuaaacucauuagguaaagguauacaucaaaucuuuggggcagcauuuaagucgcuauuuggaggaaugagcugguuuagccaaaucuuaauugguacacuacuagucuggcuaggauuaaacacaaaaaaugguucaauaagcuuaaccugucuagcauuagggggcguacuaaucuucuuaucaacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4889 - RNA, 2284 nt, Artificial Sequence
  KX601167.1 prME-short mRNA Design 1 opt
gggagaaagcuuaccaugacaucaguggguaucguaggauuauuacuuacaacagcaauggcaguugaaguaacaaggaggggauccgcauauuauauguacuuagacagaagugacgccggugaagcaauaucauuuccaacaacacuaggaguuaauaaauguuauauacaaauuauggaccuaggacacaugugugaugcaacaauguccuacgaauguccaaugcuagacgaaggaguggaaccagaugauguagauuguugguguaauacaacaaguacauggguaguuuaugggacaugucaucauaagaaaggagaagcacgaagaucaaggagagcugucacauuaccaucacacaguacgagaaaacuacaaacaagaagucaaacauggcuagaaucaagggaauauacuaaacaucuuauaaggguugaaaauuggauauucagaaauccaggauucgcacuagcagcugcagcuauagcguggcuuuuggguaguaguacuagccaaaaagucauauauuugguuaugauucuacuaauugcaccggcauauuccauacguuguauaggaguaucaaauagagacuuuguugaaggaaugucaggaggaaccuggguagauguaguacuagaacacggaggcuguguuacggucauggcacaagauaaaccaacaguagauauagaacugguuacaacaacaguaagcaauauggcugaaguacgaagcuacugcuacgaagcaaguauaucagauauggcaucagacucacgauguccaacacaaggagaagcauauuuagauaaacaaagugauacucaauauguauguaaaagaacucuaguagauagaggaugggggaaugggugcgguuuauucggaaaagguagucuaguuaccugugccaaauuugcaugcucaaagaaaaugacuggaaaaaguauacagccugaaaauuuagaauauagaauaaugcuaucaguacauggaagucaacauuccggaaugauagucaaugauacaggacaugaaacagaugaaaauagagcaaaaguagaaauuacaccaaacaguccaagagcagaagcaacauuaggagguuuugguucauuaggauuagauugcgaacccagaacaggacuagacuuuagugacuuauauuaccuaacaaugaauaauaaacauugguuagugcauaaagaaugguuucaugauauaccauuaccauggcacgcaggagcugauacgggaacaccacacuggaauaauaaagaggcucugguagaauuuaaagaugcacacgcaaaaagacaaacaguaguuguuuuggguagccaagaaggugcaguucacacagcguuggccggagcauuagaggccgaaauggauggugcaaaaggaagacuaucaaguggacaucuaaaauguagacuaaaaauggacaaauuaagauuaaaaggaguaaguuauagccuaugcacagcugcauuuacauucacaaaaauaccagccgaaacauuacauggaacaguaacaguagaaguucaauaugcaggaacagacggaccaugcaaaguaccugcacaaauggcugucgauaugcaaacauuaacuccaguuggaagauugauaacagcaaauccaguaauaacagaaaguaccgaaaacagcaaaaugauguuagaacuugauccaccuuuuggugauaguuauauagugauuggcguaggagauaagaaaauuacacaccauugguauagaucaggaucaacaauaggaaaagcauucgaagcaacuguaagaggagcaaaacgaauggcaguauuaggagacacugcaugggauuuuggaagcguaggaggagcguuaaauucacuaggcaaaggaauacaucaaauauuuggagcagcauuuaaaaguuuguuuggcggaaugagcugguuuagucaaauauuaauaggaacauuauuaguaugguuaggacuaaacacgaaaaauggaucaauaagucuaacauguuuagcucuagguggaguauuaauauuuuuaaguacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4890 - RNA, 2284 nt, Artificial Sequence
  KX694533.2 prME-short mRNA Design 1 opt
gggagaaagcuuaccaugacaucaguuggaauaguuggacuauuacucacuacagcaauggcaguagagguaacacgaagaggcucagcauauuauauguaccuugauaggucagaugccggaaaagcaauuucauuuccaacaacauuagguguaaacaaaugcuauauacaaauaauggaucuaggccauaugugugaugcaacuaugucauaugaaugcccaauguuagaugaaggaguagaaccagaugauguagacuguugguguaauacuacaaguacuuggguaguauauggaacaugucaccauaaaaaaggagaagcaagaagaagcaggagagcagucacauugcccucacauucuacaagaaaauugcaaacgagaagccaaacuugguuggaaucaagagaauacacaaaacacuuaauaagaguagaaaauuggauauuuagaaacccaggauucgcauuggccgcagcagcuauagcaugguuauuaggaucuucuacgucgcaaaagguaauauaucuaguaaugauauuauuaauagcccccgcguauucaauuagauguauuggaguaucaaauagagacuucguagaagggaugucaggaggaacaugggucgauguuguuuuagaacacgguggaugcgucaccguuauggcacaagauaaaccuacagucgauauugaacuaguaacuacuacugucucaaacauggcagaaguucgaaguuauuguuaugaagcaucaauuucagauauggcaucagauaguagauguccaacccaaggagaagcuuauuuagacaaacaaagcgacacacaauauguuuguaaaagaacauuaguugauaggggcuggggaaaugguuguggauuauucggaaaaggaaguuuaguuacaugugcaaaauucgcuuguucuaaaaaaaugacgggaaaaaguauccaaccugagaauuuagaauauagaauaaugcuaucaguacacggaagucaacacagcgggaugauaguaaaugacauaggacaugaaacggaugaaaauagggcuaaaguagaaauaacaccgaacucaccaagagccgaagcaacacuuggugguuucggaucauuaggacuggauugcgaaccaagaacuggauuagacuucagcgaucuauauuacuuaacaaugaauaauaaacacugguuaguacauaaagaaugguuccaugauauaccauuacccuggcaugcaggagcagauacgggaacaccacauuggaauaacaaagaagcccuaguagaauucaaagaugcacaugccaaaagacaaacaguaguaguucuagggagucaagaaggagcaguacauacugcacuagcaggagcauuggaagcagagauggauggagcaaaaggaagauuaucaaguggucauuuaaaaugcagauugaaaauggauaaauuacgauuaaaaggaguaucauacucucuuugcacagcagcauuuacuuucacuaaaauuccagcugaaacucuucauggaacaguaacaguagaaguccaguacgcgggaacagauggaccaugcaaaguaccugcacaaauggcaguagacaugcaaacauuaaccccaguaggaagauuaauaacagcaaacccuguaauaacagaaaguacugaaaacucuaaaaugauguuagaauuagauccaccuuuuggagauucauauauagucauaggaguuggagauaaaaaaauaacacaccacuggcauaggucaggaagcacaauuggaaaagcauuugaagcuaccguaagaggcgcaaaaagaauggcaguauuaggagacacagcaugggauuucgguucuguaggaggugcguuaaacucauuggguaaagggauacaccaaaucuuuggagccgccuuuaagagccuauuuggaggaaugaguugguuuagucaaauacuaauaggaacacuauuaguaugguugggacuaaauacaaaaaauggaagcauaucacuuacauguuuagcauuaggagguguauuaauauuucugucaacugcaguuagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4891 - RNA, 2284 nt, Artificial Sequence
  KY288905.1 prME-short mRNA Design 1 opt
gggagaaagcuuaccaugacaaguauaggaauuguaggucuacuucucacuacagcaauggcagcugagauaacaagacgggguagugcauacuauauguaccuagacagaagugacgcagguaaagcaauuucauuugcaacuacauuaggcguaaacaaaugucauguacaaauaauggauuuaggacauaugugcgacgcaacaaugucauaugaaugcccuaugcuggaugagggaguugaaccugacgauguagauuguugguguaauacaacaucaacauggguagucuacggaacaugccaucauaagaaaggagaagcaagaagaaguaggagagcagugacacuaccuucucauaguacaagaaaauuacaaacuagaagucaaacauggcuagaaucaagagaauauacaaaacauuuaauaaaaguugaaaauuggauauuuagaaauccaggauuuacauuaguagcuguugcaauagcauggcuauugggaucaaguaccagucaaaaaguuauuuaucuaguaaugaucuuauuaauagccccugcauauagcauacgauguauaggaguuucaaacagagauuuuguagaaggaaugaguggagguaccuggguagauguaguauuagaacauggaggcugcguaacggugauggcucaagauaagccaacaguugauauagaauuaguaacaacaacaguaagcaacauggcagaaguuagaagcuacuguuacgaagcaaguauaagugauauggcaucagauaguagaugcccaacgcaaggagaagccuacuuagauaaacaaagugauacacaauauguaugcaaaagaacauuaguugaucgaggauggggaaacgguugcgguuuauuuggaaaaggaucuuuaguaacuugugcaaaguuuacauguaguaagaaaaugacugguaaaagcauacaaccagaaaaucuagaauauagaauaauguuaucaguacauggaagccaacacagcggaaugauaguuaaugacaccggacacgaaacagacgaaaauagagccaaaguagaaguuacaccaaacaguccucgagcggaagcaacacuaggcggauucggaaguuuaggauuagacugugaaccuagaacaggccuagauuuuagugacuuauacuacuuaacaaugaauaacaaacauugguuaguacacaaagaaugguuccaugacaucccacuaccauggcacgcuggugcagauacuggaacaccacauuggaauaauaaagaagcauuaguagaauuuaaagaugcacaugcuaaaagacaaacaguuguuguuuuaggaucucaagaaggagcaguacauacagcacuagcuggcgcucuggaggcugaaauggauggagcgaaaggaagauuauucucaggacacuuaaaauguagauuaaaaauggauaaauugagacuaaagggaguaaguuauagucuauguacagcagcauuuacguuuacaaaagugccugcagaaacacuacauggaacugucacgguagaaguucaauaugcaggaacugauggaccguguaaaguaccagcacaaauggcaguagauaugcaaacauuaaccccuguaggaagacugauaacagcaaacccgguaauaacagaaaguacagaaaacaguaaaaugauguuagaauuggacccgccauucggagauagcuauauaguaauuggcguaggagauaagaaaauaacucaccauuggcacagaaguggaucaacaauaggaaaagcauucgaagcaacaguaagaggagcaaaacgaauggcaguauugggagauacagcaugggauuuuggaucaguaggaggcguauuuaacucgcuaggaaaagggauacaucaaaucuuuggagcagccuucaaaaguuuauuuggaggaaugagcugguuuagucaaauacuuauaggaacacuauuaguaugguuaggauuaaacacuaaaaacggaaguaucucuuuaacauguuuagcauuaggaggagugaugauauucuuaucgacagcugugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4892 - RNA, 2284 nt, Artificial Sequence
  KF268950.1 prME-short mRNA Design 1 opt
gggagaaagcuuaccaugacaaguauaggaauaauaggucucuuguuaacgacagcuauggcagcagaaauaacaagacgagggagugcauauuauauguaccuagaccguucugacgccggaaaagcuauaucauuugccacaaaccucggaguaaacaagugucauguacaaauaauggaucucggucauaugugugacgcgacuaugaguuaugaauguccaaugcuagaugaaggaguagaaccagacgacguugauugcugguguaauacaacaagcacuuggguaguauauggaacaugucaucacaagaaaggggaggccagaagaucaagacgagcaguaacauuaccaucccacagcacaagaaaauuacaaacaagaagucaaacaugguuagaaaguagagaauauacuaaacauuuaauaaaaguugaaaauuggauuuucagaaauccaggauucgcauuagcagcaguagcaauagccuggcuauuaggaucaucaacuucacaaaaaguaauuuaucuggucaugauauuacuaauagcaccagcauauagcauaagaugcauaggaguaaguaacagagauuuuguagaaggaaugaguggaggaacauggguugaugucguauuagaacauggagguuguguaacuguuauggcgcaagauaaaccaacaguagacaucgaauuaguuacaacaacaguaagcaauauggcugaaguaaggaguuauuguuaugaagcauccauuucggauauggccucagauaguagaugcccuacacaaggagaagcauauuuagauaaacaaucagacacacaauaugucugcaaacgaacucuagucgauagaggaugggguaauggcuguggccuauucgguaaaggaucccuaguaacaugcgcaaaauucacaugcucuaagaaaaugacagggaaaucaauccaaccugaaaauuuggaauaucgaauaauguuaaguguacacgggagucaacacucaggaaugauaguaaaugauauagggcaugaaacagaugaaaacagagcaaaaguagaaguaacgccuaauucaccaagagcugaagcaacacuagguggauuugggaguuuaggauuagacugugaaccaagaacaggauuagauuucucagaccucuacuacuuaacaaugaauaauaaacacuggcuaguacauaaagaaugguuccaugauauuccuuuaccauggcacgcaggagcagauacaggcacaccucauuggaacaauaaagaagcucuaguagaauuuaaagaugcacaugcaaaaagacaaacugugguuguauuagguucacaagaaggagcaguacauacagcacuagcuggcgcauuggaagcagaaauggacggagcaaaagguaggcucuuuaguggacaucuaaaauguagguuaaaaauggacaaacuuagguuaaaaggaguaucauacucacuaugcacugcugcuuucacauucacaaaaguacccgcagaaacauuacacggaacagugacaguugaaguacaauaugcuggaacugauggucccuguaagguaccagcacaaauggccguagauaugcaaacauuaacuccaguagguagacuaauaaccgcaaauccaguaauuacagaauccacagaaaauaguaagaugaugcuagagcuagauccaccauuuggagauaguuauauagucauaggaguaggugacaagaaaaucacacaucacuggcauagaaguggcagcacaauuggaaaagcauuugaagcaacaguaagaggagcaaaaagaauggcaguauuaggugauacagcaugggauuuuggaaguguagguggaguuuuuaauucacuaggaaaaggaguacaucaaauauuuggagccgcuuucaaaucacuauuuggaggaaugaguugguuuucucaaauauuaauaggaacauuauuaguaugguuaggucuaaacacuaaaaauggaucaaucucauuaacauguuuagcacucggaggaguuaugauuuuccuaagcacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4893 - RNA, 2284 nt, Artificial Sequence
  KF383121.1 prME-short mRNA Design 1 opt
gggagaaagcuuaccaugacuucaauagguauaauaggucuauuacuaacaacagcaauggcugcagaaauaacacgaagaggaucagcuuacuacauguaucuagacagaagugaugcuggaaaagcaauuagcuucgcaacaacacucggaguuaauaaaugccacguucaaauaauggacuuaggacauaugugugaugcaacuaugaguuacgaauguccaaugcuugacgaagguguugaaccagaugauguagacuguugguguaauacgacuagcacguggguaguauacggaacaugucaucauaaaaaaggcgaagcuagaagaagucgacgagcaguuacacuaccgagucacaguacaagaaaacuacaaacacgaucacaaacaugguuagaaaguagagaauauacaaaacaccuaauaaagguugagaauuggaucuucagaaauccgggguucgcucuuguagcaguagccauagcaugguuauuaggaucuagcacaucacaaaaaguaaucuaucuaguuaugauacuuuugauagcaccagcuuauaguauaagauguauuggaguaucaaauagagacuucguagaaggaaugucuggaggaaccuggguagauguaguauuagaacacggcggaugcguuacaguaauggcccaagauaaaccaacaguagacauagaauuaguaaccacgacaguaaguaauauggcggaagugagaaguuauugcuaugaagcaaguauaucagauauggcaucagauucacgaugcccaacacaaggagaagccuauuuagauaaacaaagcgauacacaauacguuugcaaaagaacucuaguagacagaggauggggaaauggauguggauuauucggaaaaggaucuuuaguaaccugugcaaaauuuacaugcaguaaaaaaaugacagguaaaaguauacaaccagaaaauuuagaauauagaaucaugcuuucaguacacggaucacaacauagcgguaugauaguaaacgacauaggacaugaaaccgaugaaaauagggcaaaaguagagguaacaccaaacucaccaagagcagaagcuacuuuaggaggauuuggaucauuaggguuggauugugaaccacgaaccggacuagauuuuagugaucuauacuaucuaacaaugaauaacaaacauugguugguacauaaagaaugguuucacgacauuccucuaccauggcaugcuggugcagauacuggaacaccacauuggaauaauaaagaagcacuaguagaguuuaaagaugcccaugccaaacgacaaacaguaguaguacuaggaagucaagaaggagcaguacauacagcauuagcuggagcauuagaagcggaaauggauggagcaaaaggaagacuauucaguggucaccuaaaauguagauuaaaaauggauaaauuaagauuaaaaggagugucauauucccuaugcacagcggcauucacauuuacgaaaguuccagcagaaacacuccauggaacagugacaguagagguacaauacgcuggaacugaugguccaugcaaaguaccggcacaaauggcgguugauaugcagacauuaacaccaguagggagguuaauaacagcaaauccaguaauuacagaaagcacagaaaacucuaaaaugaugcuagaguuagauccacccuuuggagacaguuacaucguaauaggaguaggagauaaaaaaauaacgcaucauuggcauagaucagguucuacuauuggcaaagcuuuugaggcaacaguaagaggagcaaaaaggauggcagucuuaggugauacggcaugggauuuuggcucuguaggaggaguuuuuaacaguuuagguaaaggaauucaccaaauauuuggagcggcauuuaaaagcuuauuuggaggaaugaguugguuuucacaaauacuuauagguacguuauuagucuggcuuggauuaaacacaaaaaauggaaguauaucacuaacuugcuuagcauuaggaggcguaaugauauuuuuaaguacugcaguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4894 - RNA, 2266 nt, Artificial Sequence
  KF268949.1 prME-short mRNA Design 1 opt
gggagaaagcuuaccaugacaagcauuggaauuauaggacuauuauuaacaaccgcaauggccgcagaaauaacgagacguggaagcgcauacuauauguauuuagaccgaucugaugcaggaaaagcuauuucuuuugcgacaaauuuaggaguuaauaaaugccauguucaaauaauggaucuaggacauaugugugaugcaacaaugucauaugaauguccaauguuagaugaaggaguagaaccagacgacguagauuguuggugcaacacaacaucaacauggguaguauacggaacgugucaccauaagaaaggugaagcaagaagaucuaggagagcaguaacauuaccaucgcauagcacaagaaaacuacaaacaagaagucaaaccuggcuagaaucaagagaauacacaaaacaccucauaaaaguggaaaauuggauauucagaaacccaggauucgcuuuagcagcaguagcaauagcauggcuuuuaggaagcaguacaucccaaaaaguaauauauuuaguuaugauauuauuaauagcuccagcauacucaaucaggugcauaggaguaaguaauagggauuucguugaaggaaugucaggaggaacauggguagacguaguauuagagcacggagguugcguaacgguaauggcacaagacaaaccaacaguggauauagaauuaguaacaacaacuguuaguaauauggcggaaguacgaucauauugcuaugaggccucuauaucagacauggcaucagacagcagaugcccaacccaaggagaggcuuacuuagauaaacaaagugacacacaauacguauguaaaagaacacucguugaucgaggcuggggaaauggaugcggauuauuuggaaaaggaucuuuaguuacaugcgcaaaauuuacauguaguaagaaaaugacagggaaaagcauacaaccagaaaauuuagaauauagaauaaugcuaucuguacauggaucacaacauucagggaugauaguaaacgaugaaaaccgagcaaaagucgaaguaacuccaaauucaccucgagcggaagcaacguuaggugguuucgguaguuuagguuuagauugcgaaccuagaacaggacuggauuucagcgauuuauauuaccuaacuaugaacaauaaacauugguuagugcauaaagaaugguuucacgauauaccacucccauggcacgcaggagcugauacaggaacaccacauuggaauaauaaagaagcucuaguagaauuuaaagaugcacacgcaaaaagacaaacaguagugguacuaggaagucaagaaggagccguacauacagccuuagcaggagcauuagaagcugaaauggauggugcaaaaggaagguuauuuucaggacauuuaaaauguagacucaaaauggauaaauuaagauuaaaagguguaaguuauucacuaugcacagcagcuuuuacauuuacaaaaguaccagcagaaacacuacacgggacagugacaguagaaguacaguacgcaggaacagaugggccauguaaaguaccagcacaaauggcuguagacaugcagacauugacaccgguuggaagauuaauaacagcaaauccaguaauaacugaaaguacugaaaauucaaaaaugaugcuagaacuagacccaccauuuggcgacuccuauauaguuauaggagugggugauaagaaaaucacacaucauuggcauagaucaggaaguacgauaggaaaagcguuugaagccacgguuagaggagcuaaaagaauggcagugcuaggagauacggcuugggauuuuggaaguguaggaggcguguuuaauagccuagggaaaggaauacaucaaauauuuggggcagcuuucaaaagucuauuuggagguaugaguugguuuagucaaauauuaauagguacacuauuaguaugguuaggauugaacacuaaaaaugggagcauuaguuugacuuguuuagcacuaggugguguaaugauauuuuuaucaacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4895 - RNA, 2284 nt, Artificial Sequence
  KU955595.1 prME-short mRNA Design 1 opt
gggagaaagcuuaccaugaccucaauugguauugucggacuacuccuaacaacagcaauggcagcagaaaucacucgaaggggaucggcguacuauauguaucuugauaggagcgacgcaggaaaagcaaucucguuugcuacaacauuaggaguaaacaaaugccauguacaaauaauggauuugggacauaugugcgaugcaacaauguccuaugaguguccuauguuggacgaaggaguugaacccgacgacguagacuguugguguaauacgacaagcacauggguuguauaugguacaugucaucauaaaaaaggugaagcuagaagaucucggcgagcagugacauuaccaucacauucaacaaggaaacuacaaacuagaucacaaacaugguuagaaucacgagaauauacgaaacaucuaaucaaaguagaaaacuggauuuuucguaacccaggauuugcccuuguagcaguagcaauagcauggcuucuaggaucgaguacaucccaaaaaguaauuuauuuaguaaugauacuauuaauagcaccagcauauagcauaagauguauaggaguuaguaacagagacuucgucgaaggaaugucaggcggaacauggguugauguaguccuagaacacggcggauguguaacaguaauggcucaagauaaaccaacaguagauauagaacucgucacgacaacaguaucaaauauggccgaaguaagaaguuauuguuaugaagcgaguauuagugacauggccucagauucaagauguccaacccagggcgaagcauaucuugauaaacaaucugacacacaauauguaugcaaaagaacacuuguagacagaggauggggaaauggaugcggacuauuuggaaaaggaagccuaguaacaugugcaaaauucacuuguucaaaaaagaugacaggaaaaagcauucaaccugaaaacuuagaauaucgaauaauguuaucuguucauggaucacaacauucuggaaugauaguaaaugacacuggacaugaaacugacgaaaacagagcaaaaguagaagucacacccaauucaccaagagcagaagcuacacuaggaggauuugguagucuaggucuagauugugaaccaagaacuggacuagauuucucagacuuauacuaucugacaaugaauaacaaacacugguuaguacauaaggaaugguuucaugacauaccucucccuuggcacgcaggagcagauacagguaccccacauuggaacaauaaagaagcacuaguagaauuuaaagacgcccaugcaaaaagacaaacaguaguagucuuaggaagccaagaaggagcaguacauacagcauuagcaggagcucuagaagccgaaauggacggagcaaaagguagacuauuuucuggucaucuaaaaugccgacuaaaaauggacaaauuaagacuaaaagguguaucauacagcuuaugcacagccgcauuuacauucacuaaagucccagcagaaacauuacacgggacaguaacaguagaaguacaauaugcaggaacagacggaccaugcaaagucccagcacaaauggcaguagacaugcaaacauuaacuccaguaggaagacuaauaacagcuaacccaguuauuacagaaucgacagaaaauucaaaaaugaugcuagaacuugauccaccauuuggugauucauauauaguuauaggaguaggagauaaaaaaauaacacaucauuggcauagaucaggaucaacaauaggaaaagcauuugaagcaacaguaaggggcgccaaaagaauggcaguauuaggagacacagcaugggauuuugguucuguuggagguguauucaauucauuaggaaaaggaauccaccaaauauuuggagccgcauuuaaaucucuauuuggaggaaugucaugguucucacaaauauuaauaggaacauuguuaguauggcuaggauuaaacacgaaaaaugggucaauuagucuaaccugucuagcauugggaggaguaaugauauuucuaucaacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4896 - RNA, 2284 nt, Artificial Sequence
  KF383116.1 prME-short mRNA Design 1 opt
gggagaaagcuuaccaugacaucuaucgguauaguaggauuacuauuaacaacggcaauggccgcagagauaacucgaagaggaucagcguacuauauguacuuagauaggucugacgccggaaaagcaauaaguuuugcuacuacauuaggaguaaauaaaugucacguacaaauaauggaucuaggacauaugugugacgcuacuaugucauaugaaugcccaauguuagaugaaggcguugaaccggaugauguagauuguuggugcaauacuacaucaacauggguaguauauggaacaugucaacauaagaaaggugaagcccgaagaagucggagagcugucacauuaccaucacacucaacaagaaaauuacaaacaagaucacaaacaugguuagaauccagagaauacacaaaacaucuaauaaaaguugagaacuggauuuuuagaaacccaggcuuugcuuuaguagcaguggcaauagcgugguuauugggaaguaguacaagucaaaaagugauauauuuaguaaugauucuauuaauagcuccagcauauaguaucagauguauagguguaucaaauagagauuuuguagaaggaaugagcggaggaaccuggguagaugucguauuagaacauggaggauguguaacuguuauggcacaagacaaaccuaccguagauauagaauuaguaacaacuacuguuaguaauauggcugaagucagaagcuauugcuacgaagcaaguauaagugauauggcaagugauucgagauguccaacucaaggcgaagcauaucuugauaaacaaagcgauacacaauauguauguaaaaggacguugguagauagagguuggggaaacggauguggcuuauucggaaaaggaagucuaguuacuugcgcgaaauuuacauguagcaagaaaaugacagguaaaaguauacaacccgaaaaucuagaauauagaaucauguuaucaguacacggaucacaacauaguggaaugauaguaaaugauauaggacacgaaaccgaugaaaauagagccaaaguugaaguaacgccaaauucgccaagagcugaagcaacauuaggaggauucggaucucuuggauuagauugcgagccaagaacaggauuagacuuuagugauuuauacuaucuaacuaugaauaacaaacauugguuaguacauaaagaaugguuucaugauaucccauuaccuuggcaugcaggagcagauacagggacaccucauuggaauaauaaagaagcauuagucgaguucaaagacgcucaugcaaaaagacaaaccguaguaguacuaggaucacaagaaggagccguacauacggcgcuugcaggagcauuagaagcagaaauggauggagcaaaaggaagauuauuuucuggacauuuaaaauguagauuaaaaauggauaaacugagauuaaaaggaguuucuuauucuuuauguacagcaguuuguacagcagcuaaagucccagcagaaacacuacauggaacaguaacaguagaaguacaauaugcaggaaccgaugguccauguaaaguaccagcucaaauggcagucgauaugcaaacauuaacuccgguaggaagacuaauuacagcuaacccaguaauaacagagucaaccgaaaauagcaaaaugauguuagaauuagauccaccauuuggagauagcuacauuguaauaggaguuggagauaagaaaauaacacaucauuggcauagaucgggaagcaccauugggaaagcauucgaagcgacagugaggggagcaaaaagaauggcaguauuaggagauacagcgugggauuuuggaucuguaggaggaguauuuaauaguuugggaaaaggaauacaucaaauauuuggagcagcauuuaaaucauuauuuggaggaaugagcugguuuucacaaauauuaauaggcacacuauuggucuggcucggacugaauacuaaaaacggaaguauuaguuuaacgugccuagcauuaggaggcguaaugauauuccuuaguacagcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4897 - RNA, 2266 nt, Artificial Sequence
  KX601166.1 prME-short mRNA Design 1 opt
gggagaaagcuuaccaugaccucaauaggaauaguaggcuuguuguuaacaacagcaauggcagccgaaauuacaagaagagguuccgcauauuauauguaccuagauagaucagaugcagggaaagcaauaaguuuugcaacaacuuuaggagucaauaaaugucauguacaaauaauggauuugggacauaugugugaugcaacaaugagcuacgaauguccaauguuagaugaaggaguugaaccugacgauguagauuguugguguaauacaacaaguacauggguaguauacggaaccugucaucauaaaaaaggagaagcucgaagaagcagaagggcuguaacacuaccgucucauagcacuagaaaauuacaaacacgaucccaaacauggcuagaaaguagagaauacacaaaacauuuaauaaaaguagaaaauuggauauuuagaaaucccggauucgcuuuaguagccguagcaauugcaugguuauuaggaucaucuacaucacaaaaaguaauauaucuuguaaugauacuauuaauagcgccggcauauaguauuagaugcauaggaguaaguaauagagauuuuguagaaggaaugaguggugguacguggguagaugucguucuagaacacggaggaugcguaacaguaauggcacaagacaaaccgaccguagacauagaauuaguuacaacuaccguuucaaacauggccgaagugagaucuuacuguuaugaagcuucaauaagugauauggcaucagauucaagaugcccuacacaaggagaagcguaccuugacaaacaaucggauacacaauauguaugcaaaagaacacuaguagaucgaggauggggaaacgguuguggacuguuuggaaaaggaaguuugguaacuugugcaaaauuuacauguucaaaaaaaaugacagguaagucaauacaaccagaaaaccuugaguauagaauaaugcuaucaguacauggaagucagcacucaggaaugauaguaaaugacgaaaacagagccaaaguagaaguuacucccaauaguccacgagcggaagcaacauugggaggguuuggaucucuaggucuagauugcgaaccgagaaccggauuagauuucagugauuuauauuauuuaacaaugaauaauaaacacugguuaguucacaaagaaugguuccacgauaucccauuaccauggcaugcuggagcggauacgggcacaccacauuggaauaacaaagaagcacuaguugaauuuaaagaugcacaugcaaaacgucaaacaguaguaguauuaggaucccaagaaggcgcuguacauacagcacuagcaggugcauuagaagcugaaauggauggugcuaaaggacgcuuauuuucaggacaucuaaaaugucgucuaaaaauggacaaauuaagacuuaaaggaguaaguuauagcuuauguacugcagcauuuacuuuuacaaaaguaccagcugaaacauuacacggaacagugacaguugaaguacaauaugcugggacagacggaccauguaaaguaccagcccaaauggcaguagauaugcaaacauuaacgccuguaggucguuuaauaacugcuaacccugucauaacggaaucaacagaaaauucaaaaaugauguuagaauuagauccaccuuucggagacucauacauaguaauaggaguuggagacaagaaaauaacucaccacuggcauagaucaggaaguacgauugguaaagcauuugaagcaacggugagaggagcaaaaagaauggcaguauuaggggauacagcgugggauuuuggaaguguaggaggaguuuuuaacucauuaggaaaagguauacaccaaauauuuggugcagcauuuaaaucucuauuuggagguaugucaugguuuucacaaauauuaauagguacacuauuaguaugguugggacuaaauacaaaaaauggaucaauaucucuaacaugcuuagcuuuaggaggaguaaugauauuuuuaaguacagcagugucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4898 - RNA, 2284 nt, Artificial Sequence
  KF383118.1 prME-short mRNA Design 1 opt
gggagaaagcuuaccaugacuucaauaggaauaaucggguuacuauuaacaaccgcaauggcagcugaaauaacccgaagaggaucagcauacuauauguaccuagauagaucagacgcaggaaaagcaauaagcuuugcaacgacgcucggaguaaacaaaugucauguccaaauaauggauuugggacacaugugugacgcaacuaugucauacgaauguccaaugcuugaugaaggaguagaaccagaugauguagauuguugguguaacacaacuucaacauggguaguauacggaacuugucaucauaagaaaggagaaaccagacgaagccgaaggucaguuagucuaagauaucacuacacaagaaaacuacaaaccagaucacaaacauggcuagaaucaagagaauauaaaaaacacuuaauuaugguagagaauuggauauuucguaauccagguuuugcaauagugaguguagcaauuacuuggcuuaugggaaguuuaacuagucaaaaaguuauauauuuaguaaugauaguacuaaucguaccagcauacagcauaucaugcauaggaguuaguaacagagaucuaguugaaggaaugucaggaggaacuuggguagacguuguauuagaacacggaggauguguaacagaaauggcgcaagacaaaccgacagucgauauagaauugguaacaaugacaguaagcaauauggcagaaguaagaucauauuguuaugaagcaucacuaucugacauggcaucggcaucacgaugcccaacacaaggugaaccaaguuuagauaaacaaagugauacacaaagcguuuguaaaagaacauuaggugauagagguuggggaaacgguuguggaauauuuggaaaaggaucacucguaacauguucuaaauuuaccuguuguaaaaaaaugccaggaaaauccauucaacccgaaaauuuggaauauagaauaaugcugcccguacauggaagucaacauaguggaaugauaguaaaugauauaggacaugaaacagaugaaaaucgugcaaaaguugaaguaacaccaaauucaccuagagcagaagcaacguuaggaggauuuggaagucuaggcuuagauugugaaccaagaacaggauuagauuuuuccgauuuauauuaucuaacaaugaauaacaaacacugguuaguacauaaagaaugguuucaugauauaccauuaccauggcaugcgggagcugacacuggaacaccacauuggaacaauaaggaagcgcuuguagaauucaaagaugcacacgcaaaaagacaaacaguaguaguacuaggaucacaagaaggagcaguacauacagcauuagccggagcacuagaagcagaaauggacggagcaaaagguagacuauucaguggucauuuaaaaugcagguuaaaaauggauaaacuccguuuaaaaggaguuucuuauaguuuauguacagcagcauuuacauuuacuaaaguaccugcagaaacauuacauggaacaguaacuguagaaguacaaucagccggaacagauggaccuugcaaaguaccugcacaaauggcaguagauaugcaaacacuaacaccgguaggaagacuaauaacagcaaaccccguaauaacugaaucaacagaaaacucuaaaaugaugcuagaacuagauccuccuuuuggugacucauauaucgugauaggcguaggagauaaaaaaaucacacaucacuggcacagaucaggaucuaccauaggaaaagccuucgaagcaacaguaagaggagcaaaaaggauggcaguguuaggcgauacagcuugggauuuuggcagcguaggcggaguauuuaacucacuuggaaaaggaauacaucaaauauuuggcgcagcauucaaaucccuauuuggaggaaugaguugguuuucacaaauauuaauagguacauuacuuguaugguuagguuuaaauacaaaaaacggcucaaucaguuuaacuugccuagcuuuaggaggaguaaugauauuucuaagcacagcagugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4899 - RNA, 2281 nt, Artificial Sequence
  KX447520.1 prME-short mRNA Design 1 opt
gggagaaagcuuaccaugaguguuggaauaguaggauuauuacuuacaacagcuauggcagcagaggucacaagacgaggaucagcuuacuauauguauuuagacaggaaugaugcuggugaagcaauaucauucccgaccacccuggguaugaacaaauguuacauacaaauuauggaucuuggacacaugugugacgcaacuaugucauaugaauguccaaugcuagaugaaggaguagaaccagacgauguagacugcuggugcaacacaacaagcacuuggguaguauauggcaccugucaucauaaaaaaggagaagcuagaagaaguagaagagcaguaacauuaccaagccauuccacuagaaaauuacaaacaagaucacaaacaugguuagaauccagggaauauacaaagcaccucauaagagucgaaaauuggauauuuagaaacccaggauucgcccuugcagccgcagcaauagccugguuacuuggaucgagcacaagucaaaaaguuaucuaucucguaaugauauuauuaauagcaccagcauauagcauacgauguauuggcguaucgaauagagauuuuguagaaggaaugagcggaggaacauggguagacgucguucuagaacaugguggaugcguaacaguaauggcacaagauaaaccuacaguugauauagaauuaguaacaacaacaguaaguaauauggcagaaguaaggagcuauugcuacgaagcaucaaucagugauauggcauccgauucaagauguccaacacaaggagaagcauacuuagauaaacaaucagauacacaauauguauguaaacguacacuuguagacagaggauggggaaacggauguggucuauucggaaaggguagccuaguaacaugcgcaaaauucgcaugcaguaaaaaaaugacugguaaaagcauacaaccagaaaaucuugaauauagaauaauguuaucaguacauggaagucaacauucugggaugauaguuaaugauaccggacaugaaacugaugaaaacagagcaaaaguugaaauuacuccaaauucaccaagagcagaagcaacauuagguggcuuuggaaguuugggacuugauugcgaaccuagaacaggacuagacuuuagugauuuguauuacuuaaccaugaacaauaaacauugguuaguacauaaagaaugguuccaugacauuccauuacccuggcaugcuggagcggauaccgggacaccacauuggaacaacaaagaagcauuaguagaauuuaaagacgcacacgccaaaagacaaacuguaguaguacugggaagccaagaaggagcaguacauacagcgcuagcaggagcauuagaagcagaaauggauggugcaaaaggaagauuaagcucaggucauuuaaaaugcagacuaaaaauggacaaacuuagauuaaaagguguaaguuauucacuauguacugcagcuuucacauuuacuaaaauaccagcagaaacacuacauggcacaguuacuguagaaguccaauacgcaggaacagauggaccuuguaaaguucccgcacagauggccguagauaugcaaacacuuacuccaguaggccgacuuauaacagcaaacccuguaauaacagaaucaacagaaaauuccaaaaugauguuggaauuagaccccccguuuggugauaguuacauaguaauaggagucggggaaaaaaaaauaacccaucacuggcaucgauccggcagcacaauaggaaaagcauuugaagccacuguaagaggagcaaaaagaauggcgguauuaggagauacagcaugggauuuuggaagcguagguggcgcacuaaauuccuuaggaaaagguauacaucaaauauuuggagcugcauuuaaaucucuuuuugggggaaugucaugguuuagucaaauuuuaauaggaacucuauuaaugugguuaggucucaauacaaaaaacggaucaauaaguuuaauguguuuagcuuugggaggaguccuaauauuuuuaagcacggcuguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4900 - RNA, 2284 nt, Artificial Sequence
  KU761561.1 prME-short mRNA Design 1 opt
gggagaaagcuuaccaugacaucaguagguauaguaggacuacuguuaacaacagcaauggcagcagaaguaacuagaagaggaucggcauauuauauguaucuugaccggaaugaugcgggagaagcuauaagcuuuccaacuacuuuaggcaugaauaaauguuauauccaaauaauggaucuaggacauaugugugacgcaacaaugaguuacgaauguccaauguuagacgaagggguagagccugaugacguagauugcuggugcaacacgacaaguacaugggucgucuauggaacaugucaucauaaaaaaggagaagcacgaagaaguaggcgagcaguaacucuucccucacacaguacacgaaaauuacaaacaagaagucaaacaugguuagaaucccgagaguauacaaaacacuugauaagaguagaaaauuggauuuuuagaaauccaggauuugcacuagcagccgcagcaaucgcauggcuacuuggaagcaguacaagucaaaaagucauuuauuuagucaugauauuauuaauugcaccugcauauucaauaagaugcaucggagugucgaauagagauuuuguagaaggaaugaguggaggaacauggguagauguaguauuagaacauggaggcuguguaacugucauggcccaagauaaacccacaguagauauagaauuaguaacgacaacaguaucaaauauggcagaaguaagaucauacuguuaugaggcuaguauuucagacauggcaagugauucuagaugucccacgcaaggugaagcauaucuagacaagcaaucagauacacaauauguauguaaaaggacauuaguggaucgaggcuggggaaaugguuguggacuuuuugggaaagguucauuagucacaugugcaaaauuugcguguucaaaaaaaaugacaggaaaaaguauccaaccagaaaacuuagaauacagaauaaugcuaucuguacacggaucucaacauaguggcaugauaguaaaugauacgggacaugaaacugacgaaaacagagcaaaaguagaaauaacaccaaacucaccuagagccgaagcaacauuaggcggauuuggaucucuaggauuagauugcgaaccaagaacuggauuagauuucucagauuuauauuaucuaacaaugaauaacaaacauugguugguacauaaagaaugguuucacgacaucccauuaccauggcaugcaggagccgauacuggaacaccacauuggaacaauaaagaagcacuuguugaauuuaaagaugcacacgcaaaacgacaaacuguuguaguucuaggaucgcaagaaggugccguacauacagcgcuugcaggagcacucgaagcagaaauggauggcgcaaaaggaagauuaaguucagggcaucuuaaaugcagacuaaaaauggauaaauuaagguuaaaaggaguuucauauaguuuaugcacagcagcauuuacauuuacuaaaauaccagcggaaacauugcacggaacagugaccguagaagugcaauaugccggaacagacggucccuguaaaguaccagcucaaauggcuguagacaugcaaacguuaacuccagucggaagauuaaucacagcgaacccaguaauaacagaaaguacagaaaauucaaaaaugauguuagaauuagacccaccauuuggugauagcuauauaguaauaggaguaggugaaaaaaaaauaacccaucauuggcauaggucuggaaguacaauagguaaagcauucgaagcaacaguaagaggagcuagaagaauggcuguauugggagauacugcgugggacuuuggaucaguagggggagcccuuaauucacuaggaaaaggaauacaucaaauuuuuggagcagcauucaaaucacuauuuggagguaugucaugguuuagccaaauucuaauaggaacauuauuaauguggcuuggauuaaacacaaaaaauggaaguauuucacuaaugugccuagcacucgguggaguguuaaucuuuuuaucaacagcaguaucugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4901 - RNA, 2284 nt, Artificial Sequence
  KX806557.2 prME-short mRNA Design 1 opt
gggagaaagcuuaccaugacuucaguagguauaguaggauuacuuuuaacuaccgcgauggcagcagaaguaacaagaagagggucagcuuauuacauguacuuagacagaaaugaugcaggagaagcaaucaguuucccaacuacauuagguaugaacaaauguuacauccaaauuauggauuuaggacauaugugugacgcaacaauguccuacgaauguccaauguuagaugaaggaguugaacccgaugacgucgacuguuggugcaauacaacaaguacuuggguagucuaugggacaugccaucauaagaaaggagaagcgagaagaagucgacgagcaguaacacuaccaucucauaguacaagaaaauuacaaacacgaagucaaacauggcuagaaucuagagaauauacaaaacaucuaaucagaguagaaaauuggauguuucgaaauccuggauuugcacuagccgcagcagcaauagcauggcuauuaggaucaucaacaucacaaaaaguaauuuacuuaguaaugauuuuguuaauagcuccugcauauaguauaagaugcauaggaguaucaaacagagauuuuguagaaggaaugucaggagguacauggguagauguaguuuuagaacauggcggauguguaacaguuauggcacaagauaaaccaacuguagauauagaauuaguaacaacuacaguaucuaacauggcugaaguuagaucguacuguuacgaagcaagcauuucugacauggcaucagauucuagauguccuacacaaggagaagcauaucuugauaaacagucagauacacaauacguauguaaaagaacauuaguagauaggggauggggaaauggaugcggucuauuugggaaaggaucguuaguuacaugugcaaaauucgcauguaguaagaaaaugacaggcaaaucaauacaacccgagaaccuugaauauagaauaauguuaagcguucauggaucccaacacagcggaaugauagucaacgauaccggucacgaaacugaugaaaaccgugcaaaaguagagauaacuccaaacucaccacgugcagaagcaacauuaggagguuuuggcucucuaggacucgacugugaacccagaacuggucuagacuuuucagaucuauauuauuugacaaugaauaacaaacauuggcugguucauaaagaaugguuccaugauauaccauuaccauggcaugccggagcagauacaggaacuccgcacuggaacaauaaagaggcuuuaguagaauuuaaagaugcccaugcaaaacgacaaacaguaguuguauuaggaagucaagaaggugcaguucacacagcucuggcaggagcauuagaggcagaaauggacggcgcuaaagguagauuaucauccggacauuuaaaauguagauuaaaaauggauaaauuaagauuaaaagguguaagcuauagccuaugcacugcugcauuuacauucacaaaaauaccagcagaaacauuacauggaacaguuacgguugaaguucaauaugcagguacugacggaccauguaagguaccugcacaaauggcaguggauaugcaaacauugacucccguugguagguuaauaacagcaaauccagucauaacugaaucaacagaaaauucaaaaaugaugcuagaauuagauccuccauuuggagacaguuacauaguaauaggaguaggugaaaagaaaauaacacaucauuggcacagaagcggaaguacuaucggaaaagccuuugaagccacgguuagaggugcaaaaagaauggcgguauugggagauacagcaugggacuucggcaguguaggaggagcuuuaaauucauuaggaaaaggaauacaccaaauauucggagcugcauuuaaaagccucuucggagguaugucaugguuuucccaaauucuaauaggaacacuacuaaugugguuaggacuaaauacuaaaaauggaucaauaucacuaaugugcuuagcacucggaggaguacuaaucuuccuaucaacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4902 - RNA, 2284 nt, Artificial Sequence
  LC191864.1 prME-short mRNA Design 1 opt
gggagaaagcuuaccaugacaaguguagguauaguaggacuauuauuaacaacagcuauggcagcagaaguaacgcggagagggucagcguauuauauguaucucgauagaaacgaugccggagaagcaauaagcuuuccaacaacauugggaaugaauaaauguuauauacaaauaauggauuuaggacauaugugugaugcaaccaugucauacgagugcccaauguuagaugaagguguagaaccagaugauguugauuguuggugcaacaugacaaguacauggguagucuauggaacaugucaucacaaaaaaggagaagcaagaagaucaagaagagcaguaacacuacccucccauucaacgagaaaacuucaaacaaggagucaaacaugguuagaaucccgagaauacacaaaacaucuaauaagaguagaaaauuggauauuucgaaauccagguuuugcucuagcugcagcagcgauagcaugguuacuuggaagcucuaccucacaaaaaguaauauauuuaguuaugauucuacuaauagcaccagcauauucaauaagaugcauaggaguaucaaaucgagauuuugucgaaggaaugucaggaggaacauggguagauguuguccuagaacauggaggguguguuacuguaauggcacaagauaaaccuacaguagacauagaacuuguaacaacaacaguaucaaauauggcugaaguucguucauauuguuaugaagcuaguauaagcgacauggccagcgauucaagauguccaacacaaggagaagcauacuuagauaaacaaagugauacacaauauguaugcaaacgaacucuuguugauagaggaugggguaaugguugcggauuauuuggaaaaggaucacuuguaacaugugcaaaauuugcauguaguaagaaaaugacgggcaaaucaauacaacccgaaaauuuggaauauagaauaauguuaaguguucauggaagccaacacucaggaaugauaguaaaugauacaggacaugaaacagaugaaaaucgagcaaaaguagaaauaaccccuaacagcccacgagcagaagcaacguuaggaggauuuggaucacuaggccuagauugugaaccacgaacuggacuugacuuuagcgauuuauacuaccugacuaugaacaacaaacacugguuaguacauaaagaaugguuucaugacauaccacuuccuuggcaugcaggugcagauacaggaacaccacauuggaauaauaaagaagcuuuaguagaauuuaaagaugcgcaugcaaaacgccaaacaguuguaguauuaggcucccaagaaggagcgguacauaccgcccucgcaggagcauuagaagcagaaauggauggagccaaagguagauuaucaucuggccauuuaaaauguagguuaaaaauggacaaauuacgauuaaaagguguaaguuauucauuaugcacagcugcauucacauucacaaaaauuccagcagaaacauuacacggaacaguaacaguugaaguucaauacgcgggaaccgacggaccauguaagguaccagcccaaauggccguagacaugcaaacauuaacaccaguaggaagauuaauaacagcuaauccaguaauaaccgaaagcacagaaaauucaaaaaugauguuagaauuagauccuccauuuggagauucguauaucgugauugggguaggagaaaaaaaaauuacacaccacuggcauagaucaggcucaaccauaggaaaagcauuugaagcuacuguaagaggugcuaaaagaauggcaguucucggugacaccgcaugggacuuuggaaguguagguggugcauuaaauucauuaggaaaaggaauccaccaaauauuuggagcagcauuuaaaucguuauucggaggcaugucaugguuuagucaaauauuaauagguacuuuauuaaugugguuaggacuaaauacaaaaaaugguaguauaaguuuaauguguuuagcucuaggaggaguauugauauucuuaucaacugcaguuagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4903 - RNA, 2284 nt, Artificial Sequence
  KU744693.1 prME-short mRNA Design 1 opt
gggagaaagcuuaccaugaccagcguaggaauaguuggucuauuacuaacaacagcuauggcagcagaaguaacaagaaggggaucagcauauuauauguauuuagaucgaaaugaugcuggagaagccauaucuuuucccacaacacuaggaaugaacaaaugcuauauacaaauuauggauuuaggucauaugugugaugcaacaaugucauacgaauguccuauguuagaugaaggaguagaaccggaugauguagauuguugguguaauacaaccucaacauggguagucuacgguacuugucaucauaaaaaaggugaagcaagaaggaguaggagagcgguaacuuuaccaucgcauucaacaaggaaacuucaaacaagaagucaaacauggcuagaaaguagagaauauacaaaacaucucauaagaguugaaaacuggauauucagaaauccuggcuuugcuuuggcugcagcagcaauagcgugguuacuagggucaucaacaucgcaaaaaguuauauaccugguuaugauauuauuaauagcaccggcauauaguauuagauguauaggaguaucaaauagagauuuuguugaaggaaugagcggcggaacauggguagacguuguucuagaacauggaggaugcguaacagcuauggcucaagauaaaccgacaguagacauagaauuaguaacaacuacaguuagcaauauggcugaagucaggucauacuguuacgaagccagcauaagugauauggcuagcgacaguagaugucccacucaaggagaagcauaucuagauaaacaaagcgauacacaauauguguguaaacguacauuaguagacagaggauggggcaauggaugcggauuauuuggaaaagguagucuaguaacaugugcaaaauuugccugcagcaaaaaaaugacaggaaaaaguauacaaccagaaaacuuagaauaccgaauaauguuaucaguacaugguagucaacacaguggaauguuaguaaacgauacaggucaugaaacagaugaaaaucgugcaaaaguagaaauaacaccaaauucgccaagggcagaagcaacucuaggaggauuuggaucacuagguuuggauugugaaccaaggacaggacuagauuuuucagauuuauauuaucuaacuaugaauaauaaacauugguuagcacauaaagaaugguuucacgauauaccauuaccauggcacgcgggagcagcaacuggcacaccacauuggaauaauaaagaagcauuaguagaauucaaagaugcacacgcaaaaaggcaaacuguaguaguacuaggcucacaagaaggagccguacauaccgccuuagcaggagcauuagaagcugaaauggauggagcaaaaggaagauuaucuucuggacaucuaaaaugucgauuaaaaauggauaaacuaagauugaaaggaguaagcuacuccuuguguacagcugcauuuacauuuacaaagaucccagcugaaacaguugauggaacuguaacuguagaaggacaguauggaggaacagaugggccuuguaaaguuccagcacaaauggccguagauaugcaaacguuaacuccuguuggaagacuaauaacagcaaauccgguaaucacagaaagcacagaaaauagcaaaaugauguuagaauuagacccaccuuuuggagauucauauauaguaauugguguaggagaaaaaaaaauaacacaccacuggcauagaucuggaaguacaauaggaaaagcauuugaagcaaccguaaggggagcgaaaagaauggcaguucuaggcgauacagccugggacuuuggaagcgucggaggcgcauuaaauaguuuaggaaaaggaauacaucaaauuauaggagcugccuucaaaucauuauucggaggcaugucuugguuuagucagauauuaaucgguacauuacuaaugugguuaggauuaaauacaaaaaacgguagcauaucauuaaugugucuagcguuaggaggaguuuuaauuuuucuaaguacagcaguaucagggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4904 - RNA, 2275 nt, Artificial Sequence
  KU963574.2 prME-short mRNA Design 1 opt
gggagaaagcuuaccaugggggcagacgcuucuauaggaauaguaagccuauuauuaacuacuguuauggcagcagaaauaacaagaagggguagugccuauuauauguauuuagacagaagugaugcaggaaaagcaauaaguuuugucacaacuuuaggaguaaauaaaugucacguucaaauaauggauuuaggacauaugugcgaugcgacaaugaguuaugaauguccuauguuagaugaaggcguagaaccagaugacguagauuguugguguaauaccacaucaacuuggguuguauauggaacuugucaucacaaaaaaggagaagcgagaagaucaaggagagcaguaacauuaccaagucauucaacaagaaaacuucaaacaagaagccaaacaugguuagaaaguagagaguacacuaaacaucuaauaaaaguagaaaauuggauauuuagaaauccagguuuugcacuaguugcagucgcuauagccuggcuacuaggaucaucuacaagccaaaaaguaaucuaucuaguaaugaucuuacuaauagcaccagcauauaguauaagauguauuggaguaagcaauagagauuuuguagaaggaaugagcggaggaacuuggguugacguaguauuagaacauggcgguugcguuacagucauggcacaagauaaaccaacaguagauauugaacuagugacaacaacagugagcaauauggcagaaguaagaucguauuguuaugaagcaucaauaucugauauggcuucugauagcagaugccccacacaaggugaagcauauuuagacaaacaaagugacacacaauauguauguaaaagaacauuaguagacagaggauggggaaacggauguggauuguuuggaaaagguaguuuaguuacaugugcaaaauucacuuguucaaaaaaaaugacaggaaaaucuauccaaccagaaaauuuagaauacagaauuaugcuaaguguucauggaagucaacacucgggaaugauagucaaugacgaaaacagggccaaaguugaaguuacgccaaacucaccuagagcagaagccacacuaggaggauuuggaucacuaggacuugacugugaacccagaacgggacuagauuuuagugauuuauauuaucuuacaaugaauaacaaacauuggcuaguacacaaagaaugguuucaugacauaccacuacccuggcacaguggugcagauaccgaaacaccacauuggaacaauaaagaagcacuaguagaauucaaagaugcacaugcaaagagacagaccgugguuguacuagggagccaggaaggagcaguacacacggcauuagcgggagcauuagaagcagaaauggacggagcgaaaggaagauuaucaagcggacaucuaaaauguagauuaaaaauggauaaauugagauuaaaaggaguuucauacaguuuauguaccgcugcauuuacuuuuacuaaaguucccgcugaaacgcuacacggaacaguaacaguagaaguucaauaugccggaagagacggucccuguaaaguacccgcacaaauggccguagauaugcaaacacuaacaccggugggaagacuaauaaccgccaacccaguuauuacagaaucaacagagaauucaaaaaugauguuagaauuagaucccccauuuggugauucuuauauaguaauaggaguaggugauaaaaaaauaacccaccacuggcauaggagcggaucaauaauaggcaaagcauucgaagcaacaguccgaggagcaaaaagaauggcaguacuuggugauaccgcaugggacuuuggaaguguaggaggaguauuuaauagucuagguaaaggaauucaucaaauuuuuggagcggcuuuuaagucauuauucggaggaauguccugguucagucaaauccuaauaggaaccuugcuaguaugguuaggauuaaauacaaaaaauggcucaauuucauuaacaugucuagcacuuggcggaguaaugauauuuuuauccacugcaguaucggcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4905 - RNA, 2293 nt, Artificial Sequence
  KF383120.1 prME-short mRNA Design 1 opt
gggagaaagcuuaccaugggagccgacacuaguauaggaauaauaggauuauuauuaacuacagcaauggcggcugaaauaacucgaagaggaucagcauauuauauguauuuagauagaucagaugcuggaaaagcaauaaguuuugcaacaacaaugggaguaaacaaaugccauguacagauuauggaucuaggucacaugugugaugcuacaaugaguuaugaaugcccaauguuagaugagggaguagaaccagaugauguggauuguugguguaauacaacgucaacauggguuguauauggaacaugucaccacaaaaaaggagaagcaaggccgucaagacgagcaguaacauuaccuagucauaguaccagaaaacuacaaacuagaagccaaacaugguuagaaaguagagaauauacaaaacacuuaauaaaaguggaaaauuggauacuaaggaauccaggcuuuacuguagcggcauuagcuauggcauggcuacuugggaauucaacaucacaacgaguaauauauuuaguaaugauauuacuaauagcgccugcauauuccauaagaugcauuggaguaagcaaccgcgacuuuguagagggaaugucaggcggaacuuggguugauguaguauuagaacacgguggauguguaacuguaauggcacaagacaaaccuacaguagacauugaauuaguuacgacaacaguaagcaauauggcagaaguacguuccuauuguuaugaagcuaguauaucagauauggcaagcgauucuagauguccuacacagggagaagcauauuuagacaaacaaagugauacacaauacguaugcaaacgcacccuaguagaucgaggauggggaaacgggugcggauuauuugguaaaggaucauugguuacuugcgcgaaauuuacauguaguaaaaaaaugacaggaaaaucaauucaaccugaaaauuuagaauaucgaauaaugcugucaguacauggaucacaacauaguggcaugauagucaaugauauaggacaugaaacagaugaaaacagggccaaaguagaagucacccccaauucccccagagcagaagcgacauuaggcggcuuuggaaguuuaggauuagauugcgaacccagaacaggauuagauuuuucugauuuauauuaucuaacaaugaacaacaaacacugguuaguacacaaagaaugguuucacgacauaccccuaccguggcaugcaggagcagauaccggaacaccacauuggaauaauaaagaagcauuaguagaauuuaaagaugcucacgcaaaaagacaaacaguuguaguauuaggaucucaagaaggugcuguacauacagcacuugcaggagcauuagaagcagaaauggauggagcaaaaggaagauuauuuuccggacaccuuaaaugcagaauaaaaauggacaagcuaagauuaaagggaguaaguuauucacuauguacugcagcuuuuacauuuaguaaaguaccagcagaaacuuuacaugguaccguaacuguugaaguucaauaugcaggaagggaugggccaugcaaaguaccugcccaaauggcaguagauaugcaaacuuuaacgccuguagguagauuaauuaccgcaaauccuauuauuacagaaucaacugaaaauagccgcaugauguuagaacuagauccgccauuuggugauagcuauauaguuauaggaguaggagauaaaaaaauaacacaucauuggcauagaaguggaucaaccauaggcaaagcauuugaagcaacaguaagaggagcgaaaagaauggcaguacuaggcgauacugcaugggacuuuggaucaguagguggaguauucaauucauuaggaaaaggaguacaucaagucuuuggagcugcuuucaaaaguuuauuuggagggaugucaugguuuagccaaauauuaauugggacuuuauuaguuuggcugggauuaaauacaaaaaauggaaguauaucauuagcuugucuugcacuaggaggagcaaugauauuccuaagcacagcuguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4906 - RNA, 1576 nt, Artificial Sequence
  KU321639.1 solE mRNA Design 1 opt
gggagaaagcuuaccaugucacaaaaaguaauauauuuaguaaugauacuauuaauagcaccagcuuauagcauaagauguauaggaguuucaaacagggauuucgucgaaggaaugagugguggaacauggguagauauaguucuagaacauggagguuguguaacagugauggcacaagauaaaccaacuguagauauagaauuaguuacuacaaccguaucaaauauggcagaaguuagaucauauuguuaugaagcaucaauaagugauauggccucagauucaagauguccaacacagggggaagccuacuuagauaaacaaucagauacucaauauguauguaaaagaacauuaguagauagagguuggggaaauggauguggauuauuuggaaaagguaguuuaguaacgugugcaaaauucgcauguucuaaaaaaaugacaggaaaaaguauacaaccugaaaaccuagaauauagaauaaugcuaucaguacaugguagucaacauucgggaaugauaguaaaugauacaggacaugaaacagacgaaaauagagcaaaaguugaaauaaccccaaauaguccaagagcagaagcaacauuaggaggauuuggaucauuaggacuagauugcgaaccaagaacaggauuagauuuuagugauuuauauuaucuaacaaugaauaauaaacacugguuaguacauaaagaaugguuccaugauauaccacuaccauggcacgcaggugcagauacaggaacaccacauuggaauaauaaagaagcauuaguugaauucaaagacgcccaugcaaaaagacaaacaguaguaguacuugguagucaagaaggugcuguucacacagcauuggcaggagcauuagaagcagaaauggauggagcuaaaggaagauuaucaucaggacauuuaaaaugcagauuaaaaauggauaaacuaagacuaaaaggaguaaguuauagucuaugcacggcggcauuuacauucacuaaaauaccagcggaaacacuacaugggacaguaacaguagaaguacaauaugcaggaacagauggaccuuguaaaguuccagcucaaauggcaguagauaugcaaacauuaacaccgguagguagauuaauaacagcuaacccaguaauaacagaaaguacugaaaauucaaaaaugaugcuagaacuagauccaccauuuggagacucauauauaguaauaggaguaggagaaaaaaaaauaacucaucauuggcacagaucaggaaguacaauaggaaaggcauucgaagcaacaguaagaggagcuaaaagaauggcaguuuuaggagauacagcaugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4907 - RNA, 1576 nt, Artificial Sequence
  KU312312.1 solE mRNA Design 1 opt
gggagaaagcuuaccaugucacaaaaaguaauauauuuaguaaugauacuacucauagcaccagcuuauaguauaagaugcauuggaguaucaaaucgagauuuuguagaagguaugucaggaggaacauggguagauguaguacuagaacaugguggauguguaacuguaauggcacaagacaaaccaacaguagacauagaauugguaacaacaacaguaaguaauauggcagaaguaagaucauauuguuaugaagcaagcauaucagauauggcaagugacagcagguguccaacucaaggugaagcauaccuagauaaacaaucagauacacaauauguuuguaaaagaacauuagucgacagagguuggggaaaugguugcggacuauucggaaaaggaagcuuaguaacaugugcaaaauuugcauguagcaaaaaaaugacagguaaaucaauucaaccagaaaauuuagaauacagaauaaugcuuaguguacacgguucccaacauaguggaaugaucguaaaugacaccggacaugaaacugaugaaaaucgugcaaaaguagaaauaacaccaaauuccccaagagcugaagcaacacuaggaggauucgguucauuaggauuagauugugaaccuagaacaggauuagauuuuucagaucuauauuaucuaacgaugaauaauaaacauugguuaguacauaaagaaugguuucaugauauaccauuacccuggcaugcuggagcagauacagggacaccacauuggaauaauaaagaagcguuaguugaauuuaaagacgcacaugcaaaaagacaaacaguaguaguacuuggaucacaagaaggcgcaguacauacagcacuagcaggagcacuggaagcugaaauggauggugcaaaggguagacuaucaagcggacaucuaaaauguagacuaaaaauggauaaacuaagacuaaaaggaguuuccuauaguuuguguacagcagcauuuacuuuuacaaaaauaccagcagaaacauuacauggaacaguaacaguagaaguucaauaugcaggaacggauggaccauguaaaguaccagcacaaauggcaguagacaugcaaacauuaacaccaguaggaagauuaauaaccgcuaauccaguaauaacagaaucaacagaaaauucaaaaaugaugcuugaacuugauccaccauuuggagauucauacauaguaauaggaguaggagaaaaaaaaauaacacaucacuggcacagaaguggaucaacaauaggaaaagcauuugaagcaacgguaagaggagcaaaaagaauggcaguauuaggagauacugccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4908 - RNA, 1564 nt, Artificial Sequence
  AY632535.2 solE mRNA Design 1 opt
gggagaaagcuuaccaugucucaaaaaguaauauauuuaguuaugauauuauuaauagcaccagcauauucaauaagauguauaggaguaucaaauagagacuuuguagaaggaaugaguggaggaacauggguagauguaguacuagaacauggaggauguguaacaguuauggcacaagauaaaccaacgguagacauagaauuaguaacaacuacaguaucaaauauggcagaaguaagaagcuacuguuaugaagcaucaauuagugacauggcaagugacagcagauguccaacacaaggagaagcauauuuagauaaacaaagugauacacaauacguaugcaaaagaacauuaguagacagaggauggggaaauggauguggauuguuuggcaaaggaaguuuaguaacaugugcgaaauuuacuuguaguaagaaaaugacagggaaaucaauacaaccagaaaauuuagaauauagaauaaugcuaaguguacaugguucacaacacucagggaugauugguuacgaaacggaugaagauagagcaaaaguagaaguuacaccaaauagccccagagcagaagcaacguuagguggcuuuggcaguuuaggauuagauugugaaccaagaacaggauuagacuuuagugaucuauauuauuuaacaaugaauaauaaacauugguuaguacacaaagaaugguuccaugauauaccucuaccauggcaugcaggagcagauacaggcacaccgcacuggaauaauaaagaagcauuaguagaauuuaaagaugcacaugcaaaacgacaaaccguagucguauuaggaagucaagaaggggcaguucacacagcauuagcaggagcucuugaagcagaaauggauggagcaaaaggaagauuauucucaggacacuuaaaauguagacuaaaaauggauaaauugagacucaaagguguaucauauagucuguguacagcagcauucacauuuacaaaaguaccugcagaaacauuacaugggacaguaacaguugaaguacaauaugcagguacugauggaccauguaaaaucccuguacaaauggcaguggauaugcaaacucuaacaccaguaggaagacuaauaacagcuaauccaguaauaacagaaagcacagaaaauagcaaaaugauguuagaauuagauccacccuucggagauaguuacauaguaauaggaguuggagauaagaaaauaacacaccacuggcauagaucaggcaguacaauaggaaaagcauuugaagcuacagugagaggugcuaaacgaauggcuguauuaggagauacagcuugggauuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4909 - RNA, 1576 nt, Artificial Sequence
  KU527068.1 solE mRNA Design 1 opt
gggagaaagcuuaccaugagccaaaaaguuauauaucuaguuaugauacuauuaauagccccagcauauaguauaagguguauaggggugaguaacagagauuucguagaaggaaugucaggaggaacauggguagauguaguacuagaacacggaggauguguuacaguaauggcacaagauaaaccaacaguagauauagagcuaguaacgacaacaguaaguaauauggcagaaguucgaucuuauuguuaugaagcaaguauaagugauauggcaagugauucacguuguccaacacaaggagaagcauauuuagauaaacaaagugauacucaauauguuugcaaaagaacauuaguagauagaggauggggaaacgggugugguuuauuugguaaaggaaguuuaguaacaugcgcaaaauuugcauguagcaagaaaaugacuggaaaaaguauacaaccagaaaauuuagaauauagaauaaugcuaagcguacacgguagucaacauagugguaugauugucaaugauacuggacaugaaacagacgaaaauagagcuaaaguagaaauaacaccaaauagcccacgagcagaagcuacacucggaggauuugguucuuuaggauuggauugugaaccucgaaccggacuagauuuuagcgaucucuacuacuuaacaaugaauaauaaacauuggcuaguacauaaagaaugguuucaugauaucccauuaccauggcaugcaggagcagauacaggaacaccacauuggaacaauaaagaagcauugguagaauuuaaagacgcacaugcaaaaagacaaacuguaguaguacuaggaucacaagagggugcuguacauacagcgcuagcaggcgcacuagaagcagaaauggauggugcaaaagggcgauuaaguucaggacaucuaaaauguagauuaaaaauggauaaauuaagacuaaaaggaguaucauauucauuauguacugcugcauuuacauuuacaaaaauaccggcagaaacauuacauggaacaguaacaguagaaguacaauaugcaggaacagacggaccauguaaagucccagcacaaauggcaguugauaugcaaacauuaacaccuguaggaagauuaauaacagcaaauccaguaauaacagaaucaacagaaaacucaaaaaugauguuagaauuagauccuccauuuggugacagcuauauaguaauagguguaggagaaaagaaaauuacacaccauuggcauagaagcggaucaaccauaggaaaagcauuugaggcaacaguaagaggagcaaaaagaauggcaguauugggagacacagcaugggauuucggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4910 - RNA, 1576 nt, Artificial Sequence
  KX421193.1 solE mRNA Design 1 opt
gggagaaagcuuaccaugagccaaaaaguaauauauuuaguaaugauauuacuuauagcuccagcuuauaguauaagauguauaggggucucaaauagagacuuuguugaaggaaugaguggaggaacauggguagacguaguuuuagaacauggaggauguguaacuguaauggcacaagauaaaccgacaguagauauagaauuaguaacaacaaccguaaguaauauggcagaaguaagaagcuauugcuaugaagcaagcaucagugauauggcaagugauaguagauguccaacacaaggagaagcauaccuagacaaacaaagugacacacaauauguauguaaaagaacacuaguagauagaggauggggaaacggaugcggauuauuugguaaagguucauuaguaacaugugcaaaauuuacauguagcaaaaaaaugacaggaaaaagcauucaaccagaaaaucuagaauacagaaucaugcuaucuguacauggaucacaacacagugguaugauaguuaaugauacuggauaugaaacagaugaaaauagggcaaaaguggaaguaacuccaaauagcccaagagcagaagcuacauuaggaggauucggaaguuuaggacuagauugcgaaccaagaacaggacuagacuuuucagaucuauauuauuuaacuaugaauaauaaacauugguuaguacacaaagaaugguuucaugauauaccauuaccauggcacgcaggagcagauacuggaacaccccauuggaauaauaaagaagcacuaguagaauucaaagaugcucaugcaaaaagacaaacuguaguaguauuaggcucacaagaaggagccgugcauaccgcauuagcuggagcucuagaagcugaaauggauggagcaaaagggaaauuauucaguggacacuuaaaaugucgacuaaaaauggauaaguugaggcuaaaagguguaaguuauucauuauguacagcagcauucacauuuacuaaaguaccagcagaaacauugcauggaacgguaacaguggaaguccaauaugcaggaacggauggaccaugcaaaauaccaguacagauggcaguagauaugcagacauuaacaccaguaggaagacuaauaacagcgaauccaguaauaacagaaaguacagaaaauaguaaaaugauguuggaauuagauccccccuuuggagauucauacauaguaauaggaguaggagauaaaaaaauaacucaccauuggcauaggaguggaucaacaaucggaaaagcauuugaagcaacuguaagaggagcaaaaaggauggcaguacuaggagauacagcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4911 - RNA, 1576 nt, Artificial Sequence
  LC002520.1 solE mRNA Design 1 opt
gggagaaagcuuaccaugagucaaaaagucauauauuuaguaaugauauuauuaauugcaccugcauauaguauaagauguauaggaguaaguaauagagacuuuguagaaggaaugagugguggaacauggguagacguagucuuagaacauggaggauguguaacuguaauggcacaagacaaaccaacaguugauauagaauuaguuaccacaacaguaaguaauauggcagaaguaaggaguuauuguuaugaagcaaguaucagugacauggcaagugauagucgauguccaacacaaggagaagcauaucuagauaaacaaucagauacacaauauguauguaaaagaacauuaguagauagaggaugggguaacgguuguggacuauuugguaaaggaagcuuaguaacuugugcaaaauucacauguucaaaaaaaaugacaggaaaaucaauacaaccagaaaaucuggaauacagaauaauguuaucaguacauggaagucaacauaguggaaugacaguaaacgauauaggauaugaaacagaugaaaauagagcaaaaguagaaguaacuccaaauagcccaagggcagaagcaacacuaggagguuuuggaucacugggauuagauugcgaaccaagaacuggacucgacuucagcgauuuauacuauuuaacuaugaauaauaaacauugguuaguucauaaagaaugguuucacgacaucccauuaccauggcacgcaggagcggauacagguacaccacacuggaacaauaaagaggccuuaguagaauuuaaagaugcacaugcaaaaaggcaaacuguaguaguauugggaagucaagagggagcaguacauacagcacuagcaggugcauuagaagcagaaauggacggagcaaaagguaaacuauuuucaggacaucuaaaaugcagauuaaaaauggacaaauuacguuuaaaaggaguaaguuacucacuuuguacagcggcuuuuacauucacaaaaguaccagcagaaacauuacauggcacaguuacaguagaaguacaauaugcaggaacagacggaccauguaaaauaccaguacaaauggcaguagacaugcaaacacuaaccccgguaggaagacuuauaacagcaaauccaguaauaacagaaaguacugaaaauucaaaaaugaugcuagaauuagauccuccauuuggagauucauacauaguaauagguguaggggauaaaaaaauuacacaccauuggcauagauccggaagcacaauaggaaaagcauuugaagcaacgguaagaggagcuaaaagaauggcuguacuaggagauacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4912 - RNA, 1558 nt, Artificial Sequence
  DQ859059.1 solE mRNA Design 1 opt
gggagaaagcuuaccaugucgcaaaaaguuauauaucuaguaaugauauuauuaauagcaccagcuuauaguauaagauguauaggaguaucaaacagagauuuuguagaaggaaugagcggagggacauggguagacguaguauuagaacauggagguuguguaacaguaauggcacaagauaaaccaacggucgauauagaauugguaacgaccacgguaucaaauauggcagaaguaagaaguuauuguuaugaagcauccauaagcgauauggcaagcgauaguagauguccaacacaaggagaagcauaucuugauaaacaaucagauacccaauauguauguaaaagaacauuaguagauagaggauggggaaaugguuguggauuguucggaaaaggauccuuaguaacaugcgcaaaauuuacauguagcaaaaaaaugacuggaaaaaguauacaaccugaaaaucuagaauauagaauaauguuaucuguacauggaagucaacauucaggaaugauuguaaaugacgaaaauagagccaaaguagaagugacaccaaauagcccaagagcagaagcaacauuaggagguuuugguagcuuaggauuagacugugaaccacgaacagggcuggacuuuucagacuuauauuaucuaacuaugaauaauaaacauuggcucguacauaaagaaugguuucacgauauaccacuaccauggcaugcaggagcagauacaggcacaccacauuggaauaauaaagaagcauuaguagaauucaaagacgcacacgcaaaaagacaaacaguaguaguacuaggaucacaagaaggagcaguacauacagcuuuagcaggagcucuagaagcagaaauggauggagcaaaagguagacuauucagcggacauuuaaaauguagauuaaaaauggauaaacuaagguuaaaaggaguaaguuauaguuuauguacagcagcauuuacauuuacgaaaguaccagcagaaacauugcacggaacagugacaguugaaguacaauaugcgggaacagacggaccaugcaaaguaccagcacagauggccguagauaugcaaacauuaacaccaguaggucgacuaauaacugcaaauccaguuauuacagaaucuacagaaaauagcaaaaugaugcuagaguuagauccuccauucggagacaguuauauaguaauaggaguuggagauaaaaaaauaacacaucauuggcauagaaguggaaguacaauaggaaaagcauuugaagcaacaguaagaggagcuaaaagaauggcuguuuuaggagauacagcaugggacuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4913 - RNA, 1564 nt, Artificial Sequence
  KU963573.2 solE mRNA Design 1 opt
gggagaaagcuuaccaugucacaaaaaguaauauacuuaguuaugauacuauuaauagcaccugcuuacagcauacgaugcauugguguaagcaaucgugacuuuguagagggaaugagcgguggaacauggguagacguaguauuagaacacggaggauguguaacaguaauggcgcaagauaaaccaaccguagauauagaauuaguuacaacaacaguaucaaauauggcagaaguaagaucauauuguuaugaagcaagcauaucagauauggcaagugacagucgaugcccaacacaaggagaagcauauuuagauaaacaaagcgauacacaauacguauguaaaagaacauuaguagauaggggauggggcaacgguugcggauuauucggcaaaggaagccuaguuacaugugccaaauuuacauguaguaaaaaaaugacuggaaaaucaauacaaccugaaaauuuagaauauagaauuaugcuaaguguacacggaagccaacacucaggaaugauuggauacgaaacagaugaaaacagggcuaaaguagaagucacaccaaauucaccaagagcagaagcaacacuuggaggcuucgguucgcuaggacucgauugugaaccaagaacaggacuagacuuuucugacuuauauuaucuaacaaugaauaauaaacauuggcuaguacauaaagaaugguuccacgauauaccauugccauggcacgcaggugcagauacaggaacaccacauuggaauaacaaagaagcauuaguagaauuuaaagacgcccaugcuaaaagacaaacaguaguaguacuaggaagucaagagggugcaguccauacagcauuagcaggagcacuagaagcagaaauggauggggcuaaagguaaauuauuuaguggacauuuaaaauguagauuaaaaauggacaaauuaagauuaaaaggaguaaguuacagcuuauguacagcagccuucacauuuacaaaaguaccagcagaaacauuacauggaacaguuacaguagaaguacaauaugcaggaacagauggaccauguaaaauaccaguccaaauggcaguagauaugcaaacauuaacaccaguaggaagauuaauaacagcaaauccuguaauaacagaaaguacagaaaauagcaaaaugauguuagaacuagauccaccauuuggugacaguuauauagugauaggaguuggagacaaaaaaauaacacaucauuggcaucgaucaggaaguacaauuggaaaagcauucgaagcaacuguaagaggagcaaaaagaauggcugucuuaggggacacagcaugggauuucggcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4914 - RNA, 1576 nt, Artificial Sequence
  KY075939.1 solE mRNA Design 1 opt
gggagaaagcuuaccaugucucaaaaaguaauauauuuaguuaugauacuauugauagcucccgcauauagucuaagauguauaggaguaagcaauagagauuuuguagaaggaaugagcgguggaacauggguagauguaguauuagaacauggaggauguguaacaguuauggcacaagauaaaccaacaguagauauagaauuaguaacaacaacaguaucaaauauggcagaaguaagaucauauuguuaugaagcaaguauaagcgauauggcuucagauaguagaugcccaacccaaggagaagcauaccuagauaaacaaagugauacacaauacguauguaaaagaacguuaguagauagaggauggggaaauggaugcggauuauuuggaaaaggaagucuaguaacaugugcuaaauuugcauguucaaagaaaaugacaggaaaaucaauucaaccagaaaauuuagaauauagaauaauguuaagcguacaugguucacaacauaguggaaugaucguaaaugauacaggacaugaaacagaugaaaaucgagcuaaaguagaaauaacaccuaacaguccaagagcagaagcaacauuaggaggauuuggaaguuuaggauuggauugcgaaccaagaacagguuuagauuucucagauuuauauuaucuaacaaugaauaacaaacauugguugguacauaaagaaugguuucaugauauaccucuaccuuggcaugcaggagcagacacgggaacaccacacuggaauaauaaagaagcauuaguagaauuuaaagaugcucaugcaaaaagacaaacuguaguaguauuaggaagucaagaaggagcaguucauacagccuuagcaggagcauuagaagcagaaauggauggagcuaaaggaagauuaucaaguggacauuugaaaugcagauugaaaauggauaaauuaagauuaaaaggaguaucauauagucuauguacagcagcauuuacauuuacaaaaauaccagcggaaacacuacauggcacaguuacugucgaaguacaauaugcaggaacagacgguccauguaaaguaccagcacaaauggcagucgauaugcaaacauuaacaccagugggaagauuaauaacagcaaauccaguaauaacugaaucaacugaaaauucaaaaaugaugcuagaauuagauccacccuucggugauucguacauaguaauaggaguuggggaaaagaaaauaacacaucauuggcauagaucaggaaguacaauuggaaaagcauucgaagcuacuguuagaggcgcuaaaagaauggcaguauugggagauacagcaugggauuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4915 - RNA, 1576 nt, Artificial Sequence
  KX447516.1 solE mRNA Design 1 opt
gggagaaagcuuaccaugagcaaaaaaguaauauaccuaguaaugauauuacuaauagcaccagcauacaguauacgauguauaggaguaaguaacagagauuuuguugaaggaaugucaggaggaacauggguugauguaguauuagaacacggcggauguguaacaguaauggcacaagauaaaccaacaguugauauagaauuaguaaccacaacaguuagcaauauggcugaaguaagaucauauuguuaugaagcaucaauaucagauauggcaagugauucaagauguccaacacaaggugaagcauaucuagacaaacaaucagauacacaauacguauguaaaagaacacuagucgauagaggauggggaaauggaugcgguuuauucggaaaagggucacuaguuacaugugccaaauuugcaugcagcaaaaaaaugacuggaaaaucaauucaaccagaaaaucuugaauauagaauaauguuaucaguacaugguucacaacauagcggaaugauuguuaacgacaccggacaugaaacagaugaaaaucgagcaaaaguagaaauaacuccaaacucaccaagagcugaagcaacauugggaggauucggaucauuaggacuagacugugaaccaagaaccggauuagauuuuucagacuuauauuauuuaacaaugaauaacaaacauugguuaguacacaaagaaugguuucacgacauaccacuaccauggcacgcaggagcugauacagguacaccacauuggaauaacaaagaagcucucguagaauuuaaagaugcacaugcaaaacgacaaacuguagucguauuaggaucucaagaaggagcuguacauacagcacuagcaggagcauuagaagcagaaauggauggagcuaaaggaagauuaagcucaggccaucucaaaugccgauuaaaaauggauaaauuaagauuaaaaggaguaucauauucauuauguacagcagcauucacauuuacaaaaauuccagcugaaacauuacaugguacuguaacaguagaaguacaauaugccgguacagaugguccauguaagguaccugcacaaauggcaguagauaugcaaacauuaacaccaguaggaagacuaauaacagcaaauccuguaauaacagaaaguacagaaaauucaaaaaugaugcuagaauuagacccaccguucggcgauaguuauauuguaauaggaguaggagaaaaaaaaauaacucaccauuggcauagaucaggcucaacaauaggaaaagcauuugaagcaacaguaagaggagcuaaaagaauggcuguucuaggagacacagcaugggauuuugguucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4916 - RNA, 1576 nt, Artificial Sequence
  KX447515.1 solE mRNA Design 1 opt
gggagaaagcuuaccaugagccaaaaaguaaucuauuuagucaugauauuauugauagccccagcauacucuauaagauguauaggaguaaguaauagagacuucgucgaaggaaugaguggaggaacauggguagauguaguucuagaacauggaggauguguaacaguaauggcucaagacaaacccacaguagauauagaauuaguaacaacaacaguaagcaauauggcagaaguacgaaguuauugcuaugaagcaucaauaucagauauggcaucagauucaagauguccaacccaaggagaagcuuaucucgauaaacaaucagauacacaauauguauguaaaagaacucuaguagauaggggauggggaaaugguugcggucuauuuggaaaaggaaguuuagucacaugugcaaaauuugcaugcaguaaaaaaaugacaggaaaaucuauacaaccagagaacuuagaauauagaauaauguugaguguacacgguagucaacauagugguaugauagucaaugauacaggacaugaaacagaugaaaauagagcaaagguagaaauaacgccaaauucaccaagagcagaagcaacauuaggaggauuuggaagcuuaggacuagacugugaaccacgaacgggauuagauuuuagugaccuauauuauuuaacaaugaauaacaaacauuggcugguucauaaagaaugguuucacgauauaccacuaccauggcaugcuggagcagauacagguacaccacacuggaacaauaaagaagcauuaguagaauuuaaagacgcucaugcaaaaagacaaacgguaguagucuuaggaucacaagaaggagcaguacacacagcauuagcgggagcacuagaagcagaaauggauggugcaaaaggaagauuaaguaguggacaucuaaaauguagauuaaaaauggauaaauuaagguuaaaaggaguaaguuauucauuauguacggcggcauuuacauuuacaaaaauaccugcagaaacguuacauggaacaguuacagucgaaguucaauaugcuggaacagauggacccuguaaaguuccagcacaaauggcgguagauaugcaaacauuaacaccaguuggaagauuaaucacagcaaauccaguaauaacagaaaguacagaaaauaguaaaaugaugcuugaauuagauccaccauucggagauagcuauauaguaauuggaguaggugaaaaaaaaauaacgcaucauugguauagaucaggaucaacaauaggaaaagcauuugaagcaacuguaaggggagcaaaacguauggcaguauugggagauacagccugggacuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4917 - RNA, 1576 nt, Artificial Sequence
  KU758874.1 solE mRNA Design 1 opt
gggagaaagcuuaccaugucacaaaaaguaauauaucuaguaaugauauuacuuauagcuccugcauauaguauacgaugcauaggggugucaaauagagauuuuguagaaggaaugagugggggaacauggguagauguaguacuagaacacggagguuguguaacagucauggcacaagauaaaccgacuguggauauagaacuuguaacaacuacaguaucaaauauggcagaaguaagaaguuauugcuacgaagcaaguauaagcgacauggcaagcgauuccagguguccaacacaaggagaagcauaccuagauaaacaaagcgauacucaauauguauguaaaagaacgcucguagauagaggcuggggaaauggauguggauuauuugguaaagggaguuuaguuacaugugcuaaauuugcaugcaguaagaaaaugacaggaaaaaguauacaaccagaaaauuuagaauaucgaauaauguugucaguucauggaagucaacauucaggaaugauaguaaaugauacaggacaugaaacagaugaaaauagagcgaaaguugaaauaacaccaaauucaccaagagcagaagcaacacuagggggauuugggucacuaggacuagauugugaaccaagaacaggauuagauuuuucagaucucuacuaccuaacaaugaacaauaaacacugguuaguacauaaagaaugguuucacgacaucccauuaccauggcaugcaggagcagauacaggaacgccacauuggaauaacaaagaagcauuaguagaauuuaaagaugcccaugcuaaaagacaaacaguuguaguacuugguucacaagaaggugcaguacacacagcauuagcaggagcauuagaagcagaaauggauggagcaaaaggaaaacuaagcucuggacaucuaaaaugcagacuaaaaauggauaaauuaagauuaaaaggaguaagcuauagucuaugcacagcagcauucacuuucacaaaaauaccagcagaaacauuacacggaacaguaacgguagaaguacaauaugcaggaacugacggaccauguaaagugccagcacaaauggcaguagauaugcagacauuaacaccaguagguagauuaauaacagcaaacccggugauuacugaaagcacugaaaauaguaaaaugauguuagaacuagauccaccuuuuggagauaguuauauaguuauaggaguaggagaaaagaaaauaacacaccacuggcacagaucaggaucaacaauaggaaaagcauuugaagcaacaguaagaggagcaaaaagaauggcuguacuaggagauacagcaugggacuuugguaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4918 - RNA, 1576 nt, Artificial Sequence
  KU729218.1 solE mRNA Design 1 opt
gggagaaagcuuaccaugucacaaaaaguaauauauuuaguaaugauacuccucaucgcaccagcauacucaauaagauguauaggaguaucaaacagagacuuuguagaaggaauguccggaggaacuuggguugauguuguauuagaacauggaggauguguaaccguaauggcacaagacaaaccaacaguagauauugaacuaguaacaacaacaguaucaaauauggcagaaguuagaaguuauuguuacgaagcaucaauaucagauauggcaucagauucaaggugcccaacacaaggagaagcauauuuagacaaacaaucagacacacaauauguaugcaaaagaacacuggucgauagaggauggggaaacggauguggauuguucggaaaaggaucauuaguuaccugugcaaaauucgcaugcagcaaaaaaaugacaggaaaaaguauacaaccagaaaauuuagaauacagaauaauguuaaguguucacggaucacaacauaguggaaugauuguuaacgacacaggacacgaaacagaugaaaauagagcaaaaguagaaauaacgccaaauucgccaagagcagaagcaacauuagguggauuuggaagcuuagguuuagauugugaaccaagaacaggacuugauuuuagcgauuuauacuaccuaacaaugaauaauaaacauugguuaguucacaaagaaugguuucaugauauaccauuaccauggcacgcaggagcagauacaggaacaccacacuggaauaacaaagaagcacuugucgaauuuaaagaugcgcacgcaaaaagacaaacaguaguuguucuaggaucacaagaaggagcaguacauacagcucuagcuggagcacuagaagcagaaauggacggagcaaaaggcagauuauccaguggacauuuaaaauguagacuaaaaauggacaaauuaagacuuaaaggaguuaguuauucacuauguacagccgcauucacauucacaaaaauuccagcagaaacacuacauggaacaguaacagucgaaguacaauaugcaggaacagauggaccauguaaaguaccggcacaaauggcuguagacacucagacauuaacaccaguaggaagguuaauuacagcaaauccaguaauaacugaaucaacagaaaauagcaaaaugauguuagaauuagauccaccauuuggugauaguuauauuguuauaggaguaggagaaaaaaaaauaacacaucauuggcaucgaucaggaagcacaauaggaaaagcauuugaagccacuguaagaggagcaaaaagaauggcaguacucggugauacagcgugggacuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4919 - RNA, 1576 nt, Artificial Sequence
  KU501217.1 solE mRNA Design 1 opt
gggagaaagcuuaccaugucacaaaaaguaauauaccuaguaaugauauuauuaauagcuccagcauauaguauaagaugcauaggaguaaguaaucgagauuuuguagagggaaugagcggggguacauggguagacguaguauuggaacacggaggauguguaacaguaauggcacaagacaaaccaacaguagacauugaacugguuacgaccacuguaucaaauauggcagaaauaagaucauacugcuaugaagcgaguauaagugauauggcaucagauucuagauguccaacacaaggagaagcauaucuagacaaacaaagugauacacaguauguauguaaaagaacgcuaguagauagaggauggggaaauggauguggucuauuugggaaagguagcuuaguaacaugugcaaaauuugcaugcaguaaaaaaaugacaggaaaaucaauucaaccagaaaauuuagaauauagaauaauguuaucugugcauggaucacaacauucaggaaugauagugaacgauacaggacacgaaacugaugaaaauagagcaaaagucgaaauaaccccaaauucacccagagccgaagcaacauuaggaggauuuggaucacuaggccuugauugugaaccaagaacaggauuagacuuuucagacuuguauuaucuaacaaugaauaacaaacauugguuaguacauaaagaaugguuucaugauauaccauuaccuuggcaugcaggagcagauacggguacaccacauuggaauaauaaagaagcccucguagaauuuaaagaugcacaugcuaaaaggcaaacuguuguaguacuagguagucaagaaggagcuguacauacagcauuagcaggagcauuagaagcagaaauggacggggcaaaagguaggcucaguucaggacaccuaaaaugcagauuaaaaauggauaaauuaagacuaaaaggcguaaguuauaguuuauguacagcagcauuuacauucacaaaaauaccagcagaaacguuacauggaacaguaacaguagaaguacaauaugcaggaacagauggaccuugcaaaguuccagcacaaauggcaguagauaugcaaacacuaacaccaguaggaagacuaauaaccgcaaauccaguaauaacagagagcacagaaaauagcaaaaugaugcuagaauuagacccaccauucggagauuccuauauaguaauaggaguaggugaaaaaaaaauuacacaucacuggcaccgaucaggaucaacaauagguaaggcuuucgaagcaacaguaagaggagcuaaacguauggcaguauuaggagauacugcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4920 - RNA, 1576 nt, Artificial Sequence
  KU761561.1 solE mRNA Design 1 opt
gggagaaagcuuaccaugucacaaaaaguaauauacuuaguuaugauuuuguuaauagcaccagcauauucaauaagaugcauuggaguaucaaauagagauuucguagaaggaaugagcggaggcacauggguagauguaguauuagaacaugguggauguguuacuguaauggcacaagauaaaccaacuguagacauagaacuaguaacaacaacaguaucaaauauggcagaaguaagaaguuauuguuaugaagcaagcauauccgauauggccucagacaguagauguccaacacaaggagaagcuuacuuagauaaacaaucagauacacaauauguauguaaaagaacacuaguagacagaggauggggaaauggaugcgguuuauucggaaaaggaagucuaguaacaugcgcaaaauuugcauguaguaaaaaaaugacaggaaaaaguauacaaccagaaaauuuagaauacagaauaaugcuaaguguccauggaagucaacauaguggaaugauuguaaaugacacaggacaugaaacagaugaaaauagagcgaaaguagaaauaacaccaaacucaccaagagcagaagcaacauuaggaggauuuggaucauuaggucuugauugugaaccaagaacuggacuugauuuuucagauuuauauuaccuaacaaugaauaauaaacacuggcugguacauaaagaaugguuccaugacauaccucuacccuggcacgcaggagcagauacagguaccccacauuggaauaauaaagaagcauuaguagaguucaaagaugcacaugcaaaaagacaaacaguaguuguauuaggaucacaagaaggagcaguacauacagcacuagcaggagcauuagaagcagaaauggacggcgcaaaaggcagacuuagcaguggacaccuaaaaugccgcuuaaaaauggauaaacuaagauuaaaaggaguaaguuauucauugugcacagcagcauucacauucacaaaaauacccgcagaaacacuacacgguacaguuacaguugaaguacaauaugcaggaacagauggaccauguaaaguuccagcacaaauggcaguagauaugcaaacauuaacaccaguaggucgauuaauaacagcaaacccaguaauuacagaaucaacagaaaauaguaaaaugauguuagaacucgaccccccauucggagacucauacauaguuauaggaguaggugaaaaaaaaauuacacaucacuggcacagaucaggaucaacaauaggaaaagcuuuugaagcaacaguuagaggagcacgaagaauggcuguauuaggagauaccgcgugggacuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4921 - RNA, 1576 nt, Artificial Sequence
  KY075937.1 solE mRNA Design 1 opt
gggagaaagcuuaccaugucucaaaaaguuauauauuuaguaaugauuuuauuaauagcaccagcauauucaauuagauguauaggaguaucaaauagagauuuuguagagggaaugucuggaggaacauggguagauguaguucuagaacauggaggauguguaaccguaauggcgcaagauaaaccaacugucgauauagaauuaguaacaacaaccguuucaaauauggcagaaguaagaucauauuguuaugaagcaucaauaagugauaugguaagcgacucaagauguccaacacaaggagaagcauaucuggauaaacaaucggacacgcaauauguauguaaaaggacucuaguugauagaggauggggaaauggaugcgguuuauuugguaaaggaaguuuaguaacaugcgcaaaauuugcauguucaaaaaaaaugacaggaaaauccauacaaccugaaaauuuagaauacagaauaauguuaucaguacauggaagucaacauucaggaaugauaguaaacgacacaggacaugaaacagaugaaaacagagcuaaaguggaaauaacaccgaauagcccaagagcagaggcaacauuaggaggauuuggaucacugggauuagauugugaaccaagaacaggcuuagauuuuagcgacuuauacuauuuaacaaugaauaauaaacauuggcuagugcauaaagaaugguuccacgauauaccauuaccguggcaugcaggagcagauacaggaacaccacauuggaauaacaaagaagcuuuaguagaauuuaaagacgcccaugcaaaaagacaaacgguaguaguauugggaucacaagaaggugcaguacauacagcacuagcaggagcauuagaagcagaaauggauggcgcaaaaggaagacuaucgucaggacacuuaaaauguagauuaaagauggacaaacuuagauuaaaaggcguaaguuauucauugugcacagcagcauuuacauuuacaaaaauaccugcagaaacauuacauggaacaguaacuguagaaguacaauaugcaggaacagacgguccaugcaaaguaccagcacaaauggcaguagauaugcaaacacuaacaccaguaggaagacuaauaaccgcaaauccagucauaacagaaucaacagaaaauagcaaaaugaugcuagaauuagauccuccauucggagauagcuauauagucauagggguuggggaaaaaaaaauuacucaccacuggcauagaaguggaagcaccauaggaaaagcauuugaagcaacaguaagaggagccaaaagaauggcaguguuaggagauacggcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4922 - RNA, 1576 nt, Artificial Sequence
  KY014317.1 solE mRNA Design 1 opt
gggagaaagcuuaccaugagucaaaaaguaauauaccuaguaaugauacuauuaauagcaccugcauauaguauaagauguauaggaguaucaaauagagauuucguagaaggaaugucaggaggcacauggguagacguaguuuuagaacauggaggauguguaacuguaauggcacaagauaaaccuacuguagauauagaauuaguaacaacaacaguaucaaacauggcagaaguaagaaguuauuguuaugaagcaagcauaucugauauggcaucagacucaagaugcccuacacaaggagaagcguacuuagacaaacaaagcgauacacaauauguauguaaaagaacacucguagauagaggaugggggaacggaugugguuuauucgggaaaggaucccuaguaacaugugcaaaauuugcauguaguaaaaaaaugacagggaaaucaauacaaccugaaaaccuagaauauagaauaauguuaagcguacauggaucacaacauucaggaaugauuguaaacgacacaggacaugaaacagaugaaaauagagcaaaaguagaaauuacaccaaauucaccaagggcugaagcaacauuaggagguuuuggaaguuuaggauuagauugugaaccaagaacaggacuagauuucagugauuuguacuacuuaacaaugaauaauaaacauuggcuuguucauaaagaaugguuccaugauauaccacuaccauggcacgcaggagcagauacuggaacaccucacuggaacaauaaagaagcacuaguugaauucaaagacgcccaugcaaaacgacaaacugucguaguauuaggaucacaagaaggagcaguacauacagcauuagcaggagcauuagaagccgaaauggauggagcuaaaggaagauuaucaucaggacaucuaaaguguaggcuaaaaauggacaaacuaagauuaaaaggagugaguuacaguuuauguacagccgcauuuacauuuacaaaaaucccagcagaaacacugcauggaacuguaacaguugaaguacaauaugcaggaacagaugggccaugcaaaguaccagcacaaauggcaguagauaugcaaacacuaacaccaguaggaagguuaauaacagcuaauccaguaauaacagaaaguauagaaaauaguaaaaugauguuagaacuagacccaccuuucggugauucuuauauaguaauaggaguaggugaaaaaaaaauaacacaucauuggcauagaucuggaaguaccauaggaaaagcauuugaagcuacaguaagaggagcuaaaagaauggcaguauuaggagauacagcaugggauuucgguaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4923 - RNA, 1576 nt, Artificial Sequence
  KU870645.1 solE mRNA Design 1 opt
gggagaaagcuuaccaugucacaaaaaguaauauaccuaguaaugauauuacuaauagcaccagcuuacucaauaagauguauagggguaucaaauagagauuuugucgaaggaaugucuggaggaacauggguagaugucguacuugaacacggaggauguguaacaguaauggcacaagauaaaccaacaguagauauagaauuaguuacaacaacaguaucaaacauggcugaaguaagaucauacuguuacgaagccucaauuucagauauggcaagugauucuagguguccaacgcaaggagaagccuauuuagauaaacaauccgauacacaauauguuuguaaaagaacuuuaguagauagaggaugggguaacggauguggauuauucggaaaagggucucuaguaacaugugcaaaauuugcauguaguaaaaaaaugacaggaaaaucaauacaaccugaaaaucuagaauacagaauaauguuaaguguacauggaagccaacauucaggaaugauaguaaaugauacaggacaugaaacagaugaaaaccgugccaaaguagaaauaacaccaaacucaccacgagcagaagcaacuuuaggaggauuugggucacuaggacuagacugugaaccaagaacuggacuugacuuuucugaucuauauuauuuaaccaugaauaacaaacacuggcuuguacacaaagaaugguuccaugauaucccauuaccauggcacgcaggagcagauacaggaacaccccauuggaauaauaaagaagcauuaguagaauuuaaagaugcacacgcaaaacgacaaacagucguuguauuaggaucacaagaaggagcaguacauacagcacuagcaggagcacuagaagcagaaauggauggagcaaaaggaagauuaucaagcggacaccuaaaauguagacuaaaaauggauaaauuaagauuaaaaggaguaaguuauaguuuauguacagcagcauucacauucacaaaaauaccagcagaaacacuacauggaacagucacaguagaaguacaauaugcuggaacagauggaccuuguaaaguaccagcacaaauggcaguagauaugcaaacauuaacuccaguaggaagauuaauuacagcaaauccuguaauaacagaaucaaccgaaaacucaaaaaugauguuagaauuagacccaccauuuggagacucauauauagucauaggaauaggcgaaaaaaaaauaacacaucacuggcacagaaguggcucaacaauaggaaaagcauuugaagcgacaguaaggggagcaaaaagaauggccguauuaggagacaccgcaugggacuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4924 - RNA, 1576 nt, Artificial Sequence
  KU922923.1 solE mRNA Design 1 opt
gggagaaagcuuaccaugucgcaaaaaguaauauaucugguuaugauuuuguuaauagcauuagcauacucaauaagaugcauaggaguaaguaauagggauuuuguagaaggaaugaguggagguacauggguagauguaguauuagaacaugguggaugcguaacaguaauggcacaagauaaaccuacaguagacauagaauuaguaaccaccacaguuucaaacauggcagaagucagaucauacuguuacgaagcaagcauauccgauauggcaucagacucuagauguccaacccaaggugaagcauauuuagacaaacaaucagacacacaauauguauguaaacgaacuuuaguagauagaggauggggaaaugguugcggauuauuuggaaaaggaucauuaguaacaugugcaaaauucgcaugcaguaaaaaaaugacuggaaaaucaauacaacccgaaaauuuagaauauagaauaauguuaaguguucauggcagucaacauagugguaugauaguaaaugacacaggacaugaaacagaugaaaacagagcaaaaguugaaauaacaccaaacucuccaagagcagaagcaacauuaggagguuuugguaguuuaggacuagauugugaaccaagaacuggauuagauuuuucagaucuauauuauuugacaaugaauaauaaacauugguuaguucacaaagaaugguuccaugauauaccacuaccauggcaugcaggagcagauacaggaacaccacauuggaauaauaaagaagcauuaguggaauuuaaagaugcacaugcaaaacgacaaacaguaguuguacuaggaucacaagaaggagcaguacacacggcauuagcaggagcauuagaagcagaaauggauggggcaaaaggaagguuaagcuccgggcauuuaaaaugccgauuaaaaauggacaaauuaagauuaaaaggugugucuuauagucuauguacagcagcauuuacauuuacaaaaauaccggcagaaacacuucaugguacaguaacaguagaaguacaauaugcaggaacagauggcccauguaaagugccagcacaaauggcaguagacaugcaaacacuaacaccagucggaagauuaauaacugcaaauccaguaauaacagaaucaacagaaaacaguaaaaugauguuagaauuagacccuccguucggagacuccuauauaguaauaggaguaggugaaaaaaaaauaacacaucauuggcauagaucaggaucaacaauaggaaaagccuuugaagcaacaguaagaggagcaaaaagaauggcaguacuaggagacacagcaugggacuuuggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4925 - RNA, 1576 nt, Artificial Sequence
  KU497555.1 solE mRNA Design 1 opt
gggagaaagcuuaccaugucacaaaaaguaauuuacuuaguuaugauacuacuuauagcaccagcauauucaauaagauguauaggaguaucaaauagggacuuuguagaaggaaugaguggugguacuuggguagacguaguauuagaacacggaggauguguaacuguaauggcgcaagauaaaccaacaguagacauagaauuaguuacaaccaccguaaguaauauggcagaaguaagaaguuauugcuacgaagcaaguauaucagacauggcaagugauucaagauguccaacucaaggugaagcauauuuagauaaacaaucagauacacaauauguauguaaaagaacucuaguagacagaggaugggguaauggaugcggcuuauucggaaaaggauccuuaguuacaugugcuaaauuugcuuguaguaagaaaaugacaggaaaaaguauucaaccagaaaacuuagaauacagaauaauguugagcguacaugguagucagcauucaggaaugauagucaaugauacaggacaugaaacagaugaaaauagagcaaaaguagaaauaacaccaaauaguccaagagcagaagcgacauuaggaggauuuggaagccuaggacuagacugugaaccaagaaccgguuuagauuucuccgauuuauacuauuuaacaaugaacaacaaacacuggcuaguccauaaagaaugguuucaugauauuccacuaccauggcaugcaggagcagacacggguacaccacacuggaauaauaaagaagcauuaguagaauuuaaagaugcacaugcaaagagacagacaguaguuguauuaggaacacaagaaggugcaguacacacagcacuagcuggugcacuagaagcagaaauggauggagcaaaaggccgacuaaguaguggacaccuuaaauguagauuaaaaauggauaaauuaagauuaaaaggaguuucuuauaguuuauguacagcagcauucacauuuacaaaaauaccagcugaaacauuacacggaacaguaacaguugaaguucaauaugcaggaacagauggaccauguaaaguaccugcgcaaauggcuguagauaugcaaacguuaacaccaguaggaagauuaauaacugcaaacccaguuauaacagaaucuacagaaaauaguaaaaugauguuagaauuagacccuccauuuggcgauaguuauauaguaauaggaguaggagaaaagaaaauaacacaccacuggcauagaucaggaaguacaauaggaaaagcauuugaagcuacaguacgaggcgcuaaaaggauggcuguauuaggugauacagcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4926 - RNA, 1576 nt, Artificial Sequence
  KU312314.1 solE mRNA Design 1 opt
gggagaaagcuuaccaugagccaaaaaguuauauauuuaguuaugauacuauuaauagcaccagcuuacaguauaagauguauaggaguaaguaauagagauuuuguagaggguaugucaggaggaacauggguagacguaguauuagaacauggaggauguguaacaguaauggcacaagauaaaccaacaguagauauagaacuaguaacgacaacaguaucaaauauggcugaaguuaggucauauuguuaugaagcaaguauuagugacauggcaucagauagcagauguccaacacaaggagaagcauaucuagacaaacaaagugauacacaauauguaugcaaaagaaccuuaguagauagaggauggggaaacggcuguggucuauuuggaaaaggaucauuaguaacaugcgcaaaauuugcaugcaguaaaaaaaugacaggaaaaucaauacaacccgaaaaucuagaauauagaauaauguuaaguguacauggaucacaacacucgggcaugauaguaaaugauacaggacaugaaacagaugaaaauagagcgaaaguagaaauaacaccaaauaguccuagagccgaagcaacguuaggaggauuuggcucacuuggacuggauugugaaccaagaaccggacuagauuuuucagauuuauauuauuuaacaaugaacaauaaacauugguuaguacacaaagaaugguuucaugauauccccuuaccauggcacgcaggugcagauacaggaacaccacauuggaauaauaaagaggcauuaguagaauuuaaagacgcacaugcaaaaagacaaacaguaguaguauuaggaagucaagaaggagcaguacauacagcauuagcuggagcccuagaagcggaaauggacggagcaaaaggaagguuaucaaguggacauuuaaaauguagacuaaaaauggauaaauuaagacuaaaaggaguaucauacagcuuguguacagcagcauuuacauuuacaaaaauaccagcagaaacauuacacgguacaguuacaguagaaguacaauaugcaggaacagacggaccuugcaaaguauuagcacaaauggccguagauaugcaaacacuaacaccaguaggaagauuaauaacagcaaauccaguaauaacagaaagcacagaaaacaguaaaaugauguuagaacucgauccacccuucggagauuccuacauagucauaggugugggagaaaaaaaaauuacacaucauuggcauagaagcggaagcacaauaggcaaagcauuugaagcaacagucagaggagcaaagcgaauggcaguucuaggagacacagccugggauuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4927 - RNA, 1576 nt, Artificial Sequence
  KY014314.1 solE mRNA Design 1 opt
gggagaaagcuuaccaugagccaaaaaguaauauauuuaguaaugauauuacuaauagcaccagcauauaguauacgcuguauuggaguaucgaaucgagacuuuguagaaggaaugagcggaggaacauggguagauguaguacuagaacacggaggauguguuaccguuauggcacaggauaaaccaacaguagauauagaauuaguaacaacaacaguuaguaauauggcagaaguaagaagcuauuguuacgaagcaucaauaagcgacauggcaagcgauaguagaugcccaacacaaggagaagcauauuuagauaaacaaagugauacucaauauguaugcaaacgaacauuaguagacagaggauggggaaauggauguggauuauuuggaaaaggaagucuaguuacaugcgcaaaauuugcuuguagcaagaaaaugacaggaaaaucaauacaaccagaaaacuuggaauauagaauaauguuaucuguacauggaucacaacauucaggaaugauaguaaacgauacuggacacgaaacagaugaaaauagagcaaaaguugaaauuacacccaauagcccaagagcagaagcaacauuagggggauucggaucauuaggauuagacugugaaccaagaacaggauuagacuucucagauuuguauuauuuaacaaugaauaauaaacacuggcuaguacacaaagaaugguuucaugauauaccucucccauggcacgcaggagcugauacaggaacaccacacuggaauaacaaagaagcauuaguagaauuuaaagaagcacaugcaaaaagacaaacuguuguaguacuaggaagucaagaaggagcaguacacacugcauuagcaggagcuuuagaagcggaaauggauggagcaaaaggaagauuaucaaguggacaucuaaaauguagacuaaaaauggauaaacuaagauuaaaaggcguaaguuauagucuauguacggcugcguucacauucacaaaaauaccagcagaaacauuacacggaacaguaacaguagaaguacaauaugcaggcacagauggacccugcaaaguaccagcacaaauggcaguagauaugcaaacauuaacaccaguaggaagacuaauaacagcaaauccuguaauaacagaaaguaccgaaaauaguaaaaugauguuagaacuagauccaccauuuggagauaguuauauaguaaucggaguuggagaaaagaaaauaacucaucacuggcacagaagcgguaguaccauagguaaagcauuugaagcuacagugcgaggagcaaaaagaauggcaguuuuaggagauacagcaugggauuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4928 - RNA, 1576 nt, Artificial Sequence
  KX447517.1 solE mRNA Design 1 opt
gggagaaagcuuaccaugucacaaaaaguaauauacuuaguuaugauauuacucaucgcuccggcauauaguauaagauguauuggaguaucaaauagagauuuuguagaaggaaugucaggaggaacauggguagaugugguauuagaacauggcggaugcguaacaguaauggcacaagauaaaccaacaguagacauagaauuagucaccacaacagucagcaauauggcagaaguaagaagcuauugcuaugaagcaucaauaagugauauggcaagugauagcagauguccaacacaaggagaagcuuaucuagauaaacaaagugauacacaauacguauguaaaagaacauuaguugacagaggauggggaaacggcuguggacuauuuggaaaaggaaguuuaguaacaugcgcaaaauucgcauguagcaaaaaaaugacaggaaaaaguauucaaccagaaaaccuagaauauagaauaauguuaagcguacauggaagucaacauucaggaaugauaguuaacgauacaggacaugaaacagaugaaaauagagcaaaaguagaaauaaccccaaauaguccuagagcagaagcagcauuaggaggauuuggaucacuaggauuagauugcgagccaagaacaggguuagauuuuucagauuuauauuaucuaacaaugaauaacaaacauugguuaguacacaaagaaugguuccacgauauaccauuaccauggcacgcaggcgcggacacaggaacaccccauuggaacaauaaagaagcauuaguagaauuuaaagaugcgcaugcaaaacgacaaacuguaguaguacuuggaagucaagaaggagcugugcauacagcucuggcaggagcuuuagaagcagaaauggauggagcaaaaggaagauuaucaaguggucacuuaaaauguagauuaaaaauggauaaacuaagguuaaaaggugugagcuacaguuuaugcacagcugcauuuacauuuaccaaaauaccugcagaaacacuacacggcacaguuacuguagaaguccaauaugcaggaacagacggaccauguaaagugccagcacaaauggcaguagacaugcaaacauuaacaccaguggggagacuaauaacagcaaauccaguaauaacagaaaguacagaaaauaguaaaaugauguuagaauuagauccaccauucggagauucauauauagucauaggugugggugaaaaaaaaauuacacaucauuggcauagaucaggaucaacgaucgguaaagcauuugaagcaacaguacguggggcgaaacgaauggcaguauuaggagauacggcaugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4929 - RNA, 1576 nt, Artificial Sequence
  KU729217.2 solE mRNA Design 1 opt
gggagaaagcuuaccaugucacaaaaaguaauauaucuaguaaugauauuauuaauagcaccggcauauagcauaagauguaucggaguaaguaauagagacuuuguagaaggaaugaguggaggaacauggguugauguaguacuagaacauggaggaugcgugacaguaauggcucaagauaaaccaacaguagauauagaacuaguaagcacaacaguaaguaauauggcagaaguuagaagcuauuguuacgaagcaacaauaagugauauugcaagugacaguagauguccaacacaaggagaagcauaucuagauaaacaaagugauacacaauauguauguaaaagaacgcuuguagauagaggauggggaaauggcuguggacuauuuggaaaaggaagccuaguaacaugugcaaaauucgcaugcaguaaaaaaaugacaggaaaaaguauacagccagaaaauuuagaauacagaauaaugcuaaguguacauggaucacaacacaguggaaugauaguaaacgauacaggacaugaaacagaugaaaacagagcaaaaguagaaauaacaccgaauagcccgagggcugaagcaacauuaggaggauuuggaagcuuaggauuagauugugaaccaagaacaggauuagauuuuagugacuuauacuauuuaacaaugaauaauaaacacugguuaguacauaaagaaugguuccaugacauaccccuaccuuggcaugcaggugcagauacaggaacaccacauuggaauaauaaagaagcauuaguagaauuuaaagaugcucaugcuaaaagacaaacagcaguuguacuaggaucacaagaaggagcaguacauacagcacucgcaggggcauuagaagcagaaauggacggagcaaaaggcagauuaucaagcgggcauuuaaaauguagacuaaaaauggauaaauuaagacuaaaaggugugucauauucacuauguacagcugcauucacauuuacaaaaauaccagcagaaacauuacacggaacggucacagucgaaguccaauacgcaggaacagauggaccauguaaaguacccgcacagauggcaguagauaugcaaacacuuacaccaguagguagauuaauaacagcaaauccaguaauaacagaaaguacagaaaacaguaaaaugaugcuagaauuagauccaccauuuggagauucauauauaguaauuggagugggcgaaaaaaaaauuacacaucacuggcaucgaaguggaucaacaauaggaaaagcauuugaagcaaccguaaggggagcuaaaaggauggcagucuuaggagacacagcuugggauuucgguucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4930 - RNA, 1576 nt, Artificial Sequence
  KY328290.1 solE mRNA Design 1 opt
gggagaaagcuuaccaugagucaaaaaguaauauaucuagugaugauauuauuaauagcaccagcauauagcauaagauguauaggagugucaaacagagauuucguagaaggaaugucaggaggaacauggguagaugugguacuagaacauggagguugcguuaccguaauggcacaagauaaaccaacaguagacauagaauuaguaacaaccaccguaaguaauauggcagaaguuagaaguuauuguuaugaagcaagcauaagcgacauggcaagcgacagcagauguccaacacaaggagaagcauauuuagauaaacaaagcgacacacaauauguaugcaaaagaacuuuaguagauagggguuggggaaauggcuguggacuauuuggaaaagguaguuuaguaacaugugcaaaauuugcauguucaaagaaaaugacuggaaaaucaauacaaccagaaaauuuagaauaucguauaaugcuaaguguacauggaucacaacacaguggaaugauaguaaaugauacaggacaugaaacagaugaaaauagagcaaaaguagaaauaacaccaaacucacccagagcugaagcaacguuaggaggauuuggaucauuaggauuagauugugaaccaaggacaggauuagauuuuagugaucuauauuaucuaacaaugaauaauaaacacugguuaguucauaaagaaugguuucaugauauaccauuaccauggcaugcaggagcagacacaggaacaccacauuggaacaauaaagaagcgcuaguggaauuuaaagaugcacacgcaaaaagacaaacuguaguuguacuaggaagucaagaaggggcaguacauacggcucuagcuggagcacuggaagcagaaauggacggggcuaaagguagauuaucgagcggacauuuaaaauguagguugaaaauggacaaacuuagauuaaaagguguaucauauaguuuauguacagcagcguuuacguuuaguaaaauaccugcagaaacauuacacggaacaguaacagaagaaguacaauacgcaggaacggauggucccugcaaaguuccagcacaaauggcuguggacaugcaaacauuaacaccuguaggaagauuaauaacagcaaacccaguaauaacagaaagcacagaaaauaguaaaaugauguuagaauuagauccaccauuuggagauaguuauaucguaauaggaguaggagaaaagaaaaucacucaucacuggcauagaagcgguaguacaauaggaaaagcauuugaagcaacaguaagaggagcaaaaagaauggcaguacuaggagauacagcgugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4931 - RNA, 1576 nt, Artificial Sequence
  KX087101.3 solE mRNA Design 1 opt
gggagaaagcuuaccaugucacaaaaaguaauuuauuuaguuaugauauuacuaauagcaccagcauauucaauaagauguauaggagugaguaaucgagauuuuguagaaggcaugaguggaggaacuuggguagauguaguuuuagaacacggcggaugcguaacaguaauggcacaagauaaaccgacgguagacauagaauuaguaacaacaacaguuaguaacauggcagaaguaagaucauauuguuaugaagcaaguauaagugauauggcuagugauucaagauguccaacacaaggcgaagcauacuuagauaaacaaagcgauacacaauauguauguaagagaacauuaguagauagagguuggggaaauggauguggauuauuuggaaaaggaucacuaguaaccugcgcaaaauuugcuuguucaaaaaaaaugacaggaaaaucaauccaaccagaaaaucuagaauauagaauaauguuaucaguacaugggagccaacacucgggaaugauaguaaaugauacuggccacgaaacagacgaaaaucgagcaaaaguagaaauaacaccaaauucaccaagagcagaagcaacacuaggaggauuuggaucauuaggauuagacugugaaccaagaacuggacuagauuuuucagaccuauacuaucuaacaaugaauaauaaacacugguuaguacauaaagaaugguuucaugacauaccacugccauggcaugcaggcgcagauacgggaacgccacauuggaacaauaaagaagcauuaguugaauuuaaagaugcacaugcgaaaagacaaacuguaguaguauuaggaagccaagaaggagcaguucacaccgcauuagcuggagcguuagaagcagaaauggacggagcaaaagggagauuaucaagcggucaucuaaaaugcagacuaaaaauggauaaauuaagauuaaaaggaguaagcuauucgcuauguacagcagcauuuacauuuacaaaaauaccagcagaaacauuacauggaacaguaacaguagaauuacaauaugcuggcacagauggaccauguaaaguaccagcacaaauggcaguagauaugcaaacucuuacaccaguaggacgauuaauuacagcaaauccaguaauaacugaaucuacugaaaacaguaaaaugauguuagaauuagauccaccauuuggagauaguuauauaguaauaggaguaggagaaaaaaaaauaacacaucauuggcauagaucagguaguacaauaggaaaagcauuugaagcaacaguaagaggagcaaaaagaauggcaguuuuaggugauacagccugggauuuugguucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4932 - RNA, 1576 nt, Artificial Sequence
  KY003156.1 solE mRNA Design 1 opt
gggagaaagcuuaccaugagucaaaaagugaucuauuuaguaaugauucuacuaauagcaccagcauauucaauaagauguauaggcauaucuaacagggauuuuguugaaggaaugaguggaggaacuuggguagacguaguauuggaacauggaggauguguaacaguaauggcacaagauaaaccuacaguagacauagaacugguaacaacaacaguaaguaauauggcugaaguaaggucauacuguuacgaagcaaguauaagcgauauggcaagugauucaagaugcccaacacaaggagaagcauaucucgauaaacaaagcgauacacaauauguauguaaaagaacauuaguagauagaggauggggaaacgguugcggauuauuugggaaaggaucuuuaguaacaugugcaaaauucgcauguaguaaaaaaaugacaggaaaauccauacaaccagaaaacuuagaauauagaauaauguuaaguguacacgguagucaacauucaggaaugauuguaaaugauacaggacacgaaaccgacgaaaauagagcaaaaguagaaauaacaccaaacucaccaagagcagaagcaacacuaggaggauuuggaauacuuggauuagauugugaaccacgaacuggacuagauuuuucagaccuauauuaucuaacgaugaauaauaaacauuggcuaguacauaaagaaugguuucaugauauacccuuaccauggcaugcaggcgcagauacgggaacgccacauuggaacaacaaagaagcauuaguagaauuuaaagaugcacaugcaaaacgacaaacaguaguaguauuagggucacaagaaggagcaguacauacugcacuugcaggagcuuuagaagcagaaauggacggugcaaaaggaagauuaucaucaggacacuuaaaauguagauuaaaaauggacaaauuacgauuaaaaggaguaucauauagcuuaugcaccgcagcauuuacauuuacuaaaauaccugcugaaacauuacauggaaccguaacaguagaaguacaauaugcaggaacagauggaccauguaaaguaccagcacaaauggcaguagauaugcaaacacuaacaccaguaggaagacuuaucacagcaaauccaguaauaacagaaagcacggagaauucaaaaaugauguuagaacuagauccaccauuuggagacucauacauaguaauaggaguaggagaaaaaaaaauaacacaucauuggcacagaucaggaaguacuauaggaaaagcauuugaagcaacgguaagaggagcaaagagaauggcaguauuaggagauacagcaugggauuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4933 - RNA, 1576 nt, Artificial Sequence
  KU758876.1 solE mRNA Design 1 opt
gggagaaagcuuaccaugucacaaaaaguaauauauuuaguaaugauauuauuaauagcaccagcauauaguauaagauguauaggaguaaguaauagagauuucguagaaggaaugagugggggaacauggguagauguaguauuagaacauggaggguguguaacaguaauggcacaagacaaaccaaccguggauauugaauuaguaacuacuacagucaguaauauggcagaagucagaucauauuguuacgaagcuaguauaucagacauggcgagugauagcagauguccaacacaaggagaagcauauuuagauaaacaaagugauacucaauauguauguaaaagaacauuaguugauagaggguggggaaauggauguggauuauuuggaaaaggaagcuuaguaacaugugcaaaauucgcauguaguaaaaaaaugacaggaaaaaguauacaaccagaaaacuuagaauauagaauaaugcugaguguacauggaucacaacauucaggaaugauaguaaaugauacaggacaugagacagaugaaaacagagcaaagguagaaauaacuccaaacaguccacgagcagaagcaacacuagguggauuuggaucacuaggacuagauugugaaccuagaacaggauuagauuuuucagauuuauauuaucuuacaaugaacaacaaacauuggcuaguacauaaagaaugguuccacgauauaccacuaccauggcaugcuggagccgauaccggcacuccacauuggaacaauaaagaagcauuaguagaauucaaagaugcacacgcuaaaagacagacagugguaguauuaggaagucaagaaggagcaguacacacagcacuagcaggagccuuagaagcagaaauggaugggguaaaagguagguuaagcaguggacacuuaaaauguagauuaaaaauggauaaacuaagacuuaaagguguaaguuacucauuauguacagcagcuuuuacguuuacuaaaaucccugcagaaacacuacauggaacaguaaccguggaaguacaauacgcaggaacagauggaccauguaaaguaccagcacaaauggcuguagauaugcaaacauuaaccccaguaggaagauugauaacagcaaauccaguaauaacagaaaguacagaaaauaguaaaaugauguuagaauuagauccucccuuuggugauagcuauauaguuauagguguaggagaaaaaaaaauaacacaucauuggcacagaucaggcagcacaauagguaaagcuuuugaagcaacaguaagaggagcaaaacgaauggcaguguugggagauacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4934 - RNA, 1576 nt, Artificial Sequence
  KU926310.1 solE mRNA Design 1 opt
gggagaaagcuuaccaugagccaaaaaguaauuuauuuaguaaugauacuauuaauagcaccagcauauaguauaagauguauagggguauccaacagagauuucguugaaggaaugagcggaggaacauggguagauguaguuuuagaacaugguggauguguaacaguaauggcacaagauaaaccuacaguagauauagaauuaguaacaacaacaguaucaaacauggcagaaguaagaaguuauugcuaugaagcaagcauuagugauauggcaagugauagucgauguccaacacaaggagaagcauaucuagacaaacaaagugacacacaauacguauguaaaagaacauuaguagauagaggaugggguaauggcugcggacuauucgggaaaggauccuuaguaacuugugcaaaauuugccuguaguaaaaaaaugacaggaaaaucaauacaacccgaaaaucuagaauaccgaauaaugcuaaguguacacggaagucaacauucaggaaugaucgugaaugacacagggcaugaaacugaugaaaacagagcaaaaguagaaauuacaccaaauucaccaagggcugaagcaacauuaggaggauucggaaguuuaggacuggauugugaacccagaacuggauuagacuuuucagauuuauacuauuuaacaaugaauaacaaacacuggcuaguacauaaagaaugguuucacgauauaccauuaccauggcaugcaggagcagauacaggaacaccacauuggaauaauaaagaagcacuaguagaauuuaaagaugcacacgcuaaaagacaaaccguuguaguauuaggaucacaagaaggagcgguucacacagcacuagccggagcauuagaagcggaaauggauggagcaaaaggaagauuaucaucaggucacuuaaaauguagguuaaaaauggauaaacuaagacuaaaaggaguaagcuauagucuuuguacagcagcauucacauucacaaaaauaccagcagaaacauuacauggaacaguaacaguugaaguacaauaugcaggagcagacggaccaugcaaaguaccugcacaaauggcaguggauaugcaaacauuaacuccaguagguagguuaauaacagcaaacccaguaauaacagaaaguacggaaaauucaaaaaugaugcuagaauuagauccaccauuuggagauaguuauauaguaauaggaguaggagaaaaaaaaauuacacaccauuggcauagaucagguaguacaauaggaaaagcauuugaagcaaccguacguggagcuaaaagaauggcuguauuaggagauacagcaugggacuuugguaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4935 - RNA, 1576 nt, Artificial Sequence
  KU681081.3 solE mRNA Design 1 opt
gggagaaagcuuaccaugucacaaaaaguaauauaucuaguuaugauacuauuaauagcaccagccuacaguauacgauguauuggaguaaguaauagagauuuuguugaaggaaugagugggggaacauggguagaugugguacuugaacauggaggaugugucacaguaauggcacaagauaaaccaacaguggauauagaauuaguaacaacuacaguaaguaacauggcagaaguaagaaguuauugcuacgaagcuucaauaagugacauggcaagugauagcagauguccgacacaaggcgaagcauaucuagauaaacaaagcgauacucaauauguauguaaaagaacauuaguagacagagguuggggcaauggauguggauuauuugguaaaggcucucuaguaacaugugcaaaauuugcauguucaaaaaaaaugacaggaaaaucaauucaaccagaaaaucuagaauauagaauaauguuaucaguccauggaagucaacauucagguaugauaguaaacgacacaggacaugaaacagaugaaaacagagcaaaaguagaaaucacaccaaauaguccaagagccgaagcaacuuuaggaggauucggaucauuaggauuagauugcgaaccaagaaccggguuagauuuuagugauuuauauuaucuuacuaugaauaauaaacauuggcuaguacauaaagaaugguuucaugauauaccauuaccuuggcacacuggagcagauacaggaacaccacauuggaacaauaaagaagcuuuaguagaauuuaaagaugcacaugcaaaaagacaaacaguaguaguauuaggaagucaagaaggagcuguacauacugcauuagcuggugcauuagaagcagaaauggauggagcaaaaggaaggcuaagcaguggacaucuaaaauguagauuaaaaauggauaaacuaagauuaaaaggaguaucauauagucuauguacagcagcauucacauuuacaaagauaccagcagaaacacuacacgguacaguaacgguagaaguccaauaugcaggaacagauggcccuuguaaagugccagcacaaauggcaguagauaugcaaacacuaacuccaguaggaagacuuauaacagcaaauccaguuauaacagaaggcacagaaaacaguaaaaugauguuagaacucgauccaccauuuggcgauucauauauaguaauaggaguaggagaaaaaaaaauaacacaucauuggcauaggucuggaucaacuauaggaaaagcauuugaggcaacuguaagaggagcaaaaagaauggcaguuuuaggugauacagcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4936 - RNA, 1576 nt, Artificial Sequence
  KU744693.1 solE mRNA Design 1 opt
gggagaaagcuuaccaugucacaaaaaguaauauauuuaguaaugauauuguuaauagcaccagcguacaguauuagauguauaggaguuagcaauagagauuuuguagaaggaaugaguggaggaaccuggguagauguaguauuagaacaugggggauguguaacagcaauggcgcaagauaaaccaacaguagacauagaauuaguaacaacuaccguuaguaauauggcagaaguacgaagcuauuguuacgaagcuucaauaagugauauggcaagugacagcagauguccaacacaaggagaagcguaccuagauaaacaaagugauacacaauacguaugcaaaaggacuuuaguagauagaggauggggaaauggaugugguuuauuugggaaaggaagccuuguaacaugugcaaaauuugcauguagcaaaaaaaugacagguaaaucaauacaaccugaaaaucuagaauauagaauaauguuaagcguacauggaucacaacauagcggaauguuaguaaacgauacaggacaugaaacagaugaaaauagagcaaaaguagaaauaacgccaaacucaccucgagccgaagcaacauuagguggauuuggaucauuaggauuagauugcgaaccaagaacaggcuuagacuuuagcgauuuauauuacuuaacgaugaacaauaaacauugguuagcucauaaagaaugguuucaugauauaccacuaccauggcacgcgggagcagcaacaggaacgccucauuggaauaauaaagaagcauuaguagaauuuaaagaugcacaugcuaaaagacaaacaguaguaguacuaggaagccaagaaggagcaguacacacagcauuggcaggagcauuggaagcagaaauggauggagcaaaaggacgauuaaguucuggacauuuaaaaugucgauuaaaaauggauaaacuaagacucaaagggguaucauacucauuauguacagcagcguuuacauucacaaaaauaccagcagaaacaguagaugguacaguaacaguagaaggacaauaugguggaacagacggaccaugcaaagugccagcacaaauggcaguagauaugcaaacacuuacaccaguaggaagauuaauaacagcaaauccagugauaacagaaucgacagaaaacaguaaaaugauguuagaacuagauccaccuuuuggagauucauauauuguaauaggaguaggggaaaaaaaaauaacacaucauuggcauagaucuggaagcacgauaggaaaagcuuuugaagcaacaguaagaggagcaaaaagaauggcaguuuuaggggauacagcaugggauuucggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4937 - RNA, 1576 nt, Artificial Sequence
  EU545988.1 solE mRNA Design 1 opt
gggagaaagcuuaccaugagccaaaaaguuauauaccuaguaaugauauuauuaauagcaccagccuauaguauacgaugcauuggaguaucaaauagagauuucguagaaggcaugucagguggaacauggguagauguaguauuagaacauggaggauguguaacaguaauggcacaagacaaaccagcaguagauauagagcuaguaacaacuacaguaucaaauauggcagaaguaagaaguuacuguuaugaagcuagcauaagcgauauggcaucugauucuagguguccaacacaaggcgaagcauauuuagauaaacaaucugauacacaauacgucuguaaaagaacucuaguagauagaggauggggaaacggaugugguuuauucggaaaaggcagcuuaguuacaugugcaaaauuugcaugcucaaagaaaaugacaggaaaaucaauacaaccugaaaaccuagaauacagaauaauguuaucagugcacggaucacaacauagcggaaugauagucaaugauacaggacaugaaacagaugaaaacagagcuaaagucgaaauaacaccaaacaguccaagagcugaagcaacauuaggaggauucgguagcuuaggacuugauugcgaaccaagaacaggacuagauuuuucagaucuuuauuacuuaaccaugaacaacaaacauugguugguacacaaagaaugguuucaugauauaccacuaccuuggcaugcaggagcagauacuggaacaccacauuggaacaauaaagaagcauuaguagaauuuaaagacgcucaugcaaaaagacaaacagucguuguauuaggaucacaagaaggagcaguacauaccgcucuagcuggagcauuagaagcagaaauggauggagcaaaaggaagauuaucaucaggacacuuaaaaugcagacuaaaaauggacaaauuaagacucaaaggaguaucuuauucauuaugcaccgcagcauuuacauuuacaaaaauaccagcagaaacacuacauggaacuguaacagucgaaguccaauaugcaggaacagauggaccgugcaaagucccggcacaaauggcaguagacaugcaaacuuuaacaccaguaggacgauuaauaacugcaaauccuguaauaacagaaagcacagaaaauucaaaaaugaugcuagaauuagauccacccuucggagauucauauaucguaauaggaguaggagaaaagaaaauaacacaucauuggcauagaucaggaagcacuauagguaaagcauuugaagcaacaguaagaggugcaaaaagaauggccguuuuaggugauacagcaugggauuuuggcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4938 - RNA, 1576 nt, Artificial Sequence
  KY007221.1 solE mRNA Design 1 opt
gggagaaagcuuaccaugagucaaaaaguaauauauuuagugaugauacuauuaauagcaccagcauauaguauaagauguauaggugugaauaauagagauuuuguugaaggaaugucagggggaacauggguagaugucgucuuagaacacggagguuguguaacagugauggcacaagauaaaccaacaguagauauagaauuaguaacaaccacaguaaguaauauggcagaaguaagaucauauuguuaugaggcaaguauaagugauauggcaagugauaguagauguccgacacagggagaagcauauuuagauaaacaaagcgauacucaauauguauguaaaagaacauuaguagauagaggauggggaaauggaugcggauuguuuggaaaaggaagucuagugacaugugcaaaauuugcaugcuccaaaaaaaugacaggaaaaucaauacaaccagagaacuuagaauauagaauaauguuaaguguacauggaagucaacacagcggaaugauaguuaaugauacaggacaugaaacagaugaaaaucgagcgaaaguugaaauaacuccaaacucaccuagagcagaagcaacauuaggaggguucggaucauuaggacuagauugugaaccaagaacaggacuagauuucagugacuuauauuaucuaacaaugaauaauaaacauuggcuaguacauaaagaaugguuucaugauauacccuuaccauggcaugcgggugcagauacagguacaccacauuggaauaauaaagaagcccuuguggaauuuaaagaugcacacgcaaaaagacaaacaguagucguacuagguucacaagaaggagccgugcacacagccuuagcaggagcacuggaagcagaaauggauggggcaaaaggaagauuaucgaguggacaucuaaaaugcagacuaaaaauggauaaauuaagauuaaaaggaguaaguuauucauuauguacagcagcauuuacauuuacaaaaauaccagcagaaacauuacauggaacaguaacaguugaaguacaauaugcgggaacagacggaccauguaaaguaccagcacaaauggcaguagacaugcaaaccuuaaccccagucggaagacuaauaacagcaaacccgguaauaaccgaaaguacagaaaacucuaaaaugauguuagaacuagauccaccauuuggagauaguuacauaguaauaggagugggagaaaagaaaauaacacaucacuggcauagaagcggaagcacaauuggcaaagcauucgaagcaaccguaagaggagcaaaaagaauggcaguauuaggagauacugcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4939 - RNA, 1576 nt, Artificial Sequence
  KY003152.1 solE mRNA Design 1 opt
gggagaaagcuuaccaugucacaaaaaguaauauauuuagucaugauauugcuaauagcaccugcauauaguauaagauguauaggaguaaguaauagagacuuuguagaaggaaugagcggcggaacauggguagacguaguacuagaacauggaggauguguaacaguaauggcacaagauaaaccaacaguagauauagaauuaguaacaacaacaguaucuaacauggcugaaguaagaaguuauugcuacgaagcaaguauaagcgauauggcaucagauuccagauguccgacacaaggagaagcauauuuagauaaacaaagcgauacacaauaugugugcaaaagaacauuaguagauagaggauggggaaauggaugcggacuauuuggaaaagguagcuuaguaacaugugcaaaauuugcauguucuaaaaaaaugacaggaaaaagcauacaaccagaaaauuuagaauaucgaauaauguuaagcguacauggaucacagcauucaggaaugauaguaaacgauacaggucaugaaacagacgaaaauagagcaaaaguagaaauaacaccuaacuccccaagagcagaagcaacauuaggaggauuuggaucacuaggauuagauugugaaccaagaacuggacuugacuucagugacuuauauuauuuaacaaugaauaauaaacauugguuaguacauaaagaaugguuucacgacauaccauuaccauggcaugcaggagcagauacaggaacuccccauuggaauaauaaagaagcauuaguagaauuuaaagaugcacacgcaaaaagacaaacaguaguaguacuuggaagucaagaaggagcaguacauacagcuuuagcaggagcacuggaagcagaaauggacggugcuaaaggaagacuuucaaguggacaucuaaaaugucgguuaaaaauggauaaauuaagauuaaaaggcguaaguuauagcuuaugugcagcagcauuuacuuuuacaaaaauaccugcagaaacacuacacgguacaguuacgguagaaguccaauaugcuggaacggauggaccauguaaaguaccugcacaaauggcaguagauaugcagacauuaacuccagugggaagauuaaucacagcaaauccaguaauaacagaaaguacagaaaauaguaaaaugaugcuagaauuagauccaccauucggggauaguuauauaguaauaggaguaggugaaaaaaaaauaacacaucacuggcauagauccggaucgacaauaggaaaagcauuugaagcaacaguaagaggggcuaaaagaauggcaguauuaggagauacagcuugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4940 - RNA, 1576 nt, Artificial Sequence
  KX694533.2 solE mRNA Design 1 opt
gggagaaagcuuaccaugucacaaaaaguaauauaccuaguaaugauauuauuaauagcaccagcauauagcauaagauguauaggaguaaguaauagagacuuugucgaaggaaugaguggaggaacauggguagacguaguauuagaacauggaggauguguaacaguuauggcacaagauaaaccaacaguagacauagaacuaguaacaacuacaguuucaaauauggcugaaguaagaaguuauuguuacgaagcaaguauuagcgauauggcgagugauucaagaugcccaacucaaggagaagcauaucuagauaaacaaagugauacacaauauguauguaaaagaacacuaguagacagaggauggggaaauggauguggauuauuuggaaaaggaucauuaguuacaugugcaaaauuugcauguucaaaaaaaaugacaggaaaaaguauacaaccugaaaauuuggaauauagaauaaugcugaguguacauggaucacaacacaguggaaugauagucaaugauauuggacaugaaacagaugaaaaucgagcaaaaguagaaauaacaccgaauagcccaagagcagaagcaacuuuaggaggauuuggaucauuagggcuagauugugaaccuagaacuggacuagauuuuagugacuuguauuacuuaacaaugaauaacaaacacuggcugguacauaaagaaugguuucaugauauaccauuaccauggcacgcaggugcagacacaggaacaccacauuggaauaauaaagaagcauuaguagaauucaaagaugcacaugcaaaaagacaaacagugguaguauuaggaagucaagaaggagcaguacauacugcauuagcaggugcuuuagaagcagaaauggauggagcaaaaggaagauuaucuucaggacauuuaaaaugcagauuaaaaauggacaaauuaagguuaaaaggaguaaguuacagccuuuguacagcagcauuuacuuuuacgaaaauccccgcagaaacuuuacauggaacaguaacaguagaaguacaauaugcaggaacagacggaccaugcaaaguaccagcacaaauggcagucgauaugcaaacauuaacaccuguaggaagacucauaacagcgaauccgguuauuacugaaucaacagaaaauaguaaaaugaugcuagaauuagacccaccauuuggagauucguauauaguaauaggaguaggcgauaaaaaaauaacacaucauuggcauagaucaggaucaacaauaggaaaagcauuugaagcaacaguaagaggagcaaaaagaauggcaguauuaggagauacagcaugggacuuuggaucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4941 - RNA, 1576 nt, Artificial Sequence
  KX601167.1 solE mRNA Design 1 opt
gggagaaagcuuaccaugucgcaaaaaguaauauauuuaguaaugauucuauuaauagcuccugcauauucaauaagauguauagguguaagcaauagagauuuuguagaaggaaugaguggaggaacguggguagauguaguauuagaacacggaggauguguaacuguaauggcacaagauaaaccaacuguagauauagaauuaguaacaacuacaguaucaaauauggccgaaguaagaagcuauugcuaugaagcuaguauaagugacauggcaucagacucaagauguccaacacaaggcgaagcauaccuagauaaacaaagugauacacaauaugucugcaaaaggacgcuaguagauagaggauggggaaauggauguggucuauuuggaaaagggucauuagucacaugugcaaaauuugcauguucaaagaaaaugacaggaaaaucaauacagccagaaaauuuagaauauagaauuauguuaaguguacacggaagccaacacucaggaaugauuguaaacgacacaggacaugaaaccgaugaaaacagagcaaaaguagaaauaacaccuaauucaccaagagcagaagcaacguuaggaggauuugguucuuuaggacuagauugugaaccaaggacaggacuagauuuuagugacuuauauuacuuaacaaugaacaauaaacauuggcuaguucauaaagaaugguuucaugauauaccucuaccauggcacgccggagcagauacuggaaccccacauuggaauaauaaagaagcauuaguagaauuuaaagaugcacacgcaaaaagacaaacuguaguaguauuagguucucaagaaggugcaguacacacagcuuuagcaggagcauuagaagcagaaauggauggugcaaaaggaagacuaaguaguggacacuuaaaauguagauuaaaaauggauaaacuaagauuaaaaggaguaucauauucauuauguacugcagcauucacauucacaaaaauuccagcagaaacuuuacauggaacaguuacaguugaaguacaauaugcaggaacagauggaccaugcaaaguaccagcgcaaauggcaguagauaugcaaacauuaacuccaguaggacgauuaauaaccgcaaauccaguaauaacagaaaguacagaaaacaguaaaaugaugcuugaauuagacccaccauuuggagauucauauauuguaauagguguaggagacaagaaaauaacacaccacugguacagaucgggaucaacgauaggaaaagcauuugaagcaacaguaagaggagcaaaaagaauggcaguauuaggagacacagcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4942 - RNA, 1576 nt, Artificial Sequence
  KY288905.1 solE mRNA Design 1 opt
gggagaaagcuuaccaugucacaaaaagugauauauuuaguaaugauauuacuaauagcaccagcauacaguauaagauguauaggaguaucuaauagagauuuuguagaaggaaugucaggaggaacauggguagauguaguacuagaacacggaggauguguaacaguaauggcacaagacaaaccaacaguagauauagaauuaguaacaacaacuguaagcaacauggcagaaguuagaaguuauuguuaugaagcaaguauaagugauauggcaagugauucaagauguccuacacaaggagaagcauacuuagacaaacaaagcgauacacaauauguuugcaaaagaacguuagucgaccgaggaugggggaacggauguggacuauuuggaaaaggaagucuaguaacaugugcuaaauuuacauguagcaaaaaaaugacaggaaaaucaauacaaccagaaaauuuagaauacagaauaauguuaagugugcauggaucacaacauagcggaaugauaguuaaugauacugggcacgaaacugaugaaaauagagcgaaaguagaagucacaccaaacaguccaagagcggaagcaacuuuaggaggauucgguucauuaggacuagauugcgaaccuaggacuggauuagauuuuucagaucuauauuaucuuacaaugaauaauaaacauugguuaguacauaaagaaugguuucaugauauaccacuaccguggcaugcaggagcagauacaggaacaccucauuggaauaacaaagaagcauuaguagaauucaaagaugcacaugcaaaacgacaaacgguaguaguacuuggaagucaagaaggagcaguacacacagcauuagcaggagcuuuagaagccgagauggacggggcaaaaggcagacuauuuagcggacacuuaaaaugcagauuaaaaauggauaaauuaagauuaaagggaguaaguuauucauuauguacagcugcauuuacuuuuacaaaaguuccagcagagacauuacauggaacaguaacaguggaaguacaauaugcaggaacagaugggccauguaaaguuccagcacaaauggcaguagauaugcaaacauuaacuccaguaggaagacuuauuacagcaaauccaguaauaacagaaaguacagaaaauaguaaaaugaugcuugaauuagacccaccauuuggggauucuuauauagucauaggaguuggagauaaaaaaauaacucaucauuggcauagaucuggcucaacuauaggaaaagcguuugaagcaacgguaagaggagcaaaaagaauggcuguacuaggcgacacagcuugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4943 - RNA, 1576 nt, Artificial Sequence
  KF268950.1 solE mRNA Design 1 opt
gggagaaagcuuaccaugucacaaaaaguuauauauuuaguaaugauauuguuaauagcaccggcauauaguauaagauguauaggaguaucaaauagagauuuugucgaaggaaugaguggaggaacauggguugauguaguauuagaacauggcggaugcguaacuguaauggcacaagauaaaccaacuguggauauagaauuaguaacaacaacaguaagcaauauggcagaaguaagaaguuauuguuaugaagcaucaauaagugauauggcaagugauucucgaugcccgacacaaggagaagcauacuuagauaaacaaagugauacacaauauguaugcaagcgaacacuuguagacagaggauggggaaacggaugugguuuauucgguaaaggaaguuuaguaacuugugcaaaauuuacauguagcaaaaaaaugacaggaaaaucaauacaaccugagaauuuagaauauagaauuaugcuaagcguacacgggucacaacauagcggaaugauaguaaaugauauaggacaugaaacagaugaaaauagagcaaaaguagaaguaacuccaaauaguccaagagcagaagcaacauuagggggcuucgguucauuagguuuagacugcgaaccacggacuggacuagacuucucagauuuauauuauuuaacaaugaauaacaaacacuggcugguacauaaagaaugguuucacgauauaccuuuaccauggcaugcgggcgcagauacaggaacaccucauuggaauaacaaagaagcacuaguagaauuuaaagaugcacaugcaaaacgacaaacaguaguaguauuaggaagucaagaaggggcaguacauacagcacuagcgggagcauuagaggcagaaauggauggagcaaaaggaagguuauucagcggacauuuaaaauguagacuuaaaauggauaaauuaagauuaaaaggaguaagcuauaguuuauguacagcagcauuuacauuuacaaaaguaccagcagaaacauuacauggcacaguaaccguagaaguacaauaugcaggaacagauggaccaugcaaaguaccagcucaaauggcuguagauaugcaaacacuaacaccuguaggaagacugauuacagcuaauccagucauaacagaaaguacggaaaauagcaaaaugauguuagaacuagauccaccauuuggggauagcuacauaguaauaggaguaggagauaaaaaaauaacacaucacuggcauagaucaggaucaacaauaggaaaagcauuugaagcaacaguaagaggagcaaaacgcauggcaguauuaggggacacagcuugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4944 - RNA, 1576 nt, Artificial Sequence
  KF383116.1 solE mRNA Design 1 opt
gggagaaagcuuaccaugagucaaaaaguuauauauuuaguuaugauauuacuaauagcaccagcauauucaauaagauguauaggaguaagcaacagagauuuuguugaaggaaugagcgguggaacauggguagacguaguauuagaacauggaggauguguaacaguaauggcacaagauaaaccaacaguagacauagaacuaguaacaacaacaguuucaaauauggcagaaguaagaaguuauugcuaugaagcaaguauaagugacauggcaagugauaguagauguccaacucaaggugaagcauacuuagauaaacagagugacacacaauacguauguaaacgaacucuaguagacagaggcuggggaaauggaugugggcuuuucggaaaaggaucauuaguuacgugugcaaaauuuacaugcaguaaaaaaaugacaggaaaaucaauacaaccagaaaaucuggaauauagaauaauguuaagcguacauggaagucaacauucaggaaugauaguaaacgauaucggacaugaaacagaugaaaacagagcaaaaguagaaguaacuccaaauagcccaagagcagaagcaacauuaggaggauuuggaucauuaggucuagauugugaaccaagaacaggacuagauuuuagugaucuauacuaucuaacaaugaauaauaaacauugguuaguacacaaagaaugguuccaugauauaccauuacccuggcaugcaggagcagacacaggaacaccacauuggaacaauaaagaagcauuaguagaauuuaaagacgcacaugcaaaaagacaaacuguaguagugcuaggaagucaagaaggagcuguacacacagcacuagcaggugcauuagaggcagagauggauggagcaaaaggaagauuauuuaguggacaucuaaaguguagacuaaaaauggacaaauuaagauuaaaaggaguaaguuauagucugugcacagcuguaugcacagcagcaaaaguaccagcagaaacuuuacauggaacaguaacuguagaaguacaauaugcagggacagaugguccuuguaaaguaccagcucaaauggcaguagacaugcaaacgcuaacaccaguaggaagacuaaucacagcaaauccaguuauaaccgaaaguacagaaaauagcaaaaugauguuagaacucgauccuccauuuggagauagcuauaucguaauaggaguaggagacaaaaaaauaacucaucauuggcauagaaguggaucaacaauaggaaaagcauuugaagcaacaguaagaggugcaaaaagaauggcaguacuaggagacacagcaugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4945 - RNA, 1558 nt, Artificial Sequence
  KU963574.2 solE mRNA Design 1 opt
gggagaaagcuuaccaugucacaaaaaguaauauacuuaguuaugauauuacuaauagcaccggcuuauaguauaagaugcauaggaguaagcaauagagauuuuguagaaggaaugagcggaggaacauggguagauguaguauuagaacacggaggcugcguaacaguaauggcucaagauaaaccaacuguagauauagaacuaguaacaacuacaguaucaaauauggcagagguaagaaguuauuguuaugaagcaucaauaagcgauauggcaucagacaguagauguccaacacaaggugaagcauauuuagauaaacaaagugauacacaauauguauguaaaagaacccuaguagacaggggauggggaaauggcuguggauuauuuggaaaaggaucacuaguuacaugugcaaaauucacauguagcaaaaaaaugacaggaaaaucaauacaaccagaaaacuuagaauacagaauaauguuaaguguacacggaagccaacauucagguaugauaguaaaugaugaaaacagagcaaaaguagaaguuacaccaaauucaccaagagcagaagcaacacuaggaggauuugguucucuuggauuagauugugagccaagaacaggucuggauuuuagugacuuauauuacuuaacaaugaauaauaaacauugguuaguucacaaagaaugguuccaugauauucccuuaccauggcauucaggagcagauacagaaacaccacauuggaauaauaaagaagcauuaguagaauuuaaagaugcacaugcaaaaagacaaacaguuguuguacugggaagccaagaaggggcaguacauacagcauuagcuggagcacuagaagccgaaauggauggagcgaaaggcagacuaucaaguggacauuuaaaauguagauuaaaaauggauaaauuaagauuaaaaggaguaagcuacucauuauguacagcagcauucacauuuacaaaaguaccagcagaaacauuacaugguacaguaacaguagaaguccaauaugcuggaagagauggaccauguaaaguaccagcacaaauggcaguagauaugcaaacauuaacaccaguugguagauuaauaacagcuaauccagugauaacugaaucaacagaaaauaguaagaugauguuagaacuagauccaccauucggagacaguuauauaguaauaggagucggagauaaaaaaauaacgcaucauuggcauagaagcggaaguauuauaggaaaagcauucgaagcaacaguaagaggagcaaaaagaauggcgguacuaggagauacagcuugggauuuugguaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4946 - RNA, 1576 nt, Artificial Sequence
  KF383118.1 solE mRNA Design 1 opt
gggagaaagcuuaccaugucgcaaaaaguaauauaucucguuaugauaguucuaauaguaccagcuuacaguauaagcuguauaggaguaucaaauagagacuuaguggaaggcaugagcggagguacauggguagacguaguauuagaacacggaggaugcguaacagaaauggcccaagauaaaccaacuguggauauagaauuaguaacgaugacaguaagcaauauggcugagguaagaagcuauuguuacgaagcaaguuuaucagauauggcuagcgcaucaagguguccaacacaaggcgaaccaucauuagauaaacaaagugauacucaaaguguauguaaaagaacucuaggagauaggggauggggaaauggaugcggaauauucgguaaaggaagucuaguaacaugcaguaaauucacauguuguaaaaaaaugccuggaaaaucaauucaaccagaaaauuuagaauacagaauaaugcuaccaguacauggaagucaacauagcggaaugauaguuaaugauauaggacaugaaacugaugaaaacagagcaaaaguagaaguaacuccaaacagcccuagagcagaagcaacacucggaggauucggaucacucggauuagauugugaaccaagaacaggacuugacuucagugaucuuuacuauuuaacgaugaauaacaaacauugguuaguacauaaagaaugguuccaugauauaccauuaccauggcaugcaggagcagauacaggaacaccacauuggaacaauaaagaagcguuaguagaauuuaaagaugcacaugcaaaaagacaaacaguaguaguauuaggaagccaagaaggagcuguacacacggcacuagcaggggcauuagaagcagaaauggauggagccaaagguagauuauuuaguggacauuuaaaauguagauuaaaaauggauaaacuaagacuaaaaggaguaaguuacagcuuauguacagcagcauuuacauucacaaagguaccagccgaaaccuuacacggaacaguuacaguagaaguccaaagugcaggcacagaugguccauguaaaguaccggcacaaauggcaguagauaugcaaacuuuaacaccuguaggaagguuaauaacagcaaauccaguaauaacagaaagcacagaaaauaguaaaaugaugcuagaauuagacccaccauuuggagauucauauauaguaauaggagucggagauaaaaaaauaacacaucauuggcacagaaguggaucaacaauaggaaaagcauuugaagcaacaguaagaggcgccaaaagaauggcaguauuaggagauacagcaugggauuuuggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4947 - RNA, 1576 nt, Artificial Sequence
  KX520666.1 solE mRNA Design 1 opt
gggagaaagcuuaccaugagacaaaaaguaauauauuuaguaaugauauuacuaauugcaccugcauauucaauaagaugcauagguguuaguaauagagauuuuguugaaggaaugucaggaggaacuuggguagacguaguacuagaacaugguggcuguguaacaguaauggcacaagauaaaccaacaguagauauagagcuaguuacgacaacaguuagcaacauggcagagguaagaaguuauuguuaugaagcaaguauaucagacauggcaagcgauucaagguguccaacacaaggugaagcauacuuagauaaacaaagugauacacaauacguauguaaaagaaccuuaguugauagagguuggggaaaugguuguggacuauuuggaaaaggaaguuuaguuacaugcgcaaaauuugcauguaguaaaaaaaugacaggaaaaucaauacaaccagagaauuuagaauauagaauaaugcuuaguguacauggaagucaacauagcggaaugauaguaaaugacacaggacaugaaacugaugaaaauagagcaaaaguagaaauaacaccaaauucacccagagcagaagcuacauuaggaggauuuggaucauuaggauuagacugugaaccuagaaccggauuagauuuuucagaucuauauuacuuaacaaugaauaauaaacauugguuaguacauaaagaaugguuucaugauauaccguuaccauggcaugcaggcgcagauacaggaaccccacacuggaauaauaaagaagcacuaguagaauuuaaagaugcccaugcaaaacgucaaacuguaguaguacuaggaucacaagaaggagcaguacacacugcauuagccggagcuuuagaagcagaaauggauggagcgaaaggaagacuaucaucuggacaccuaaaauguagauuaaaaauggauaaauuaagauuaaaaggaguaaguuauaguuuaugcacagcagcauucacauuuacgaaaauuccagcagaaacauuacacggaacaguaacaguagaaguucaauaugcgggaacagacggaccauguaaaguaccagcacaaauggcaguugauaugcagacauugacucccguuggaagacuaauaacagcaaauccaguaauaacugaaucaacagaaaacucaaaaaugaugcuagaauuagauccaccauuuggagauucauauauaguaauaggaguaggugaaaaaaaaauaacucaucauuggcacagaagugggaguacaauaggaaaagcauuugaagcaacuguaagaggggcaaaacgaauggcaguacuaggagauacugcaugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4948 - RNA, 1576 nt, Artificial Sequence
  KF383120.1 solE mRNA Design 1 opt
gggagaaagcuuaccaugagucaaagaguaauauacuuaguaaugauauuauugauagcaccagcauauucaauuagauguauaggaguaaguaauagagauuuuguagaaggaaugaguggaggaacauggguagauguaguauuagaacauggaggauguguaacuguuauggcacaagauaaaccaacaguagauauagaauuaguaacaacaacaguaucaaauauggcagaaguaagaagcuacuguuacgaagcaucaaucucugauauggcaagugauaguagauguccgacacaaggagaagcuuauuuagauaaacaaagcgauacacaauauguaugcaaaagaacauuaguugauagaggauggggaaauggauguggauuauuuggaaaagguagucuaguaacaugugcuaaauuuacauguagcaaaaaaaugacaggaaaaaguauacaaccagaaaaucuagaauauaggauaaugcuaucaguacacggaagucaacacagcggaaugauuguaaaugacauaggacacgaaacagaugaaaaucgagcaaaaguagaaguaacuccaaauucaccuagagcagaagcaaccuuaggagguuuugggucauuaggacuagacugugaaccaagaacaggauuagauuuuagugacuuauauuacuuaacaaugaauaauaaacauuggcuaguacacaaagaaugguuucacgauauaccacuaccauggcacgcaggagcagauacuggaacaccacauuggaauaauaaagaagcauugguugaauuuaaagaugcacaugcuaaaagacaaaccguaguaguguuaggcagccaagaaggagcaguacauacagcuuuagcaggagcauuagaagcagaaauggauggagcaaaagguagauuauuuucaggacaucugaaauguagaauaaaaauggauaaauuaagauuaaaaggaguauccuauaguuuauguacagcagcauucacguuuaguaaaguaccagcagaaacguuacaugguacaguaacaguagaaguacaauaugcagguagggacggaccguguaaaguaccagcacaaauggccguagauaugcaaacauuaacaccaguaggacgauuaauaacagcaaacccaauaauaacagaaucaacugaaaauaguagaaugauguuagaauuagauccaccauuuggagauucauauauaguuauagguguaggagauaaaaaaauaacccaucauuggcauagaaguggcucaacaauagguaaggcauuugaagcgacaguaagaggagcgaaaagaauggcugugcuaggagauacugcaugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4949 - RNA, 2359 nt, Artificial Sequence
  ZIKV (strain ZikaSPH2015) Polyprotein(93-804) mRNA Design 1 opt
gggagaaagcuuaccaugcguauaaucaacgcacgaaaagagaagaaaaggcgcggcgccgacacuucagucgguaucgucggccuccuccucacaaccgccauggccgcagaagucacccgccgaggaagugcauacuacauguaccuagaccgcaaugacgccggagaagcaaucagcuuccccaccacacucgguaugaacaaaugcuacauacaaauaauggaccucggucacaugugcgacgccacgaugagcuacgaaugccccaugcucgacgaaggggucgaaccagacgacguugacugcuggugcaacacaaccucuacuugggucgucuacgguaccugccaccacaagaaaggcgaagcgcgacgaucccgcagggccgucacccugccgagccauucaacccgaaaacuacaaacccgaagccaaaccuggcucgaaucucgcgaauacaccaaacacuugauccgcgucgaaaacuggauuuucagaaacccaggcuucgcacucgcggcagccgcaauagccuggcuccucggcucaucaacaucccagaaagucaucuaccucguaaugauucuacucaucgccccagcauacucaauacggugcauaggaguguccaaccgcgacuucgucgagggaaugucaggcggcacauggguagacauaguacucgaacacggaggaugcgucaccguaauggcccaagacaaaccaaccguugacauagaacucguaaccacaaccguaagcaacauggcagaaguccgcucauacugcuacgaggcauccaucagcgacauggccuccgacagccgaugccccacccaaggagaggccuaccucgauaaacaaagcgacacccaauacgucugcaaaagaacccucguagauagagguuggggcaacggcugcggucuauucggcaaaggaagccuaguaacaugcgccaaauucgccugcuccaagaaaaugaccggcaaauccauccaaccggagaaccuugaauauagaaucaugcuguccguacacggaucccaacacuccggaaugauagucaacgacacaggccacgagaccgacgagaaccgagcaaaaguagagaucacacccaacucgccaagagccgaagccacccuagguggcuucggaucacuuggccucgacugcgaaccccggacagggcucgacuucucagaccucuacuaccucaccaugaacaacaaacacuggcuuguacacaaagaaugguuucacgacaucccacucccauggcaugcaggcgcagacaccggcacaccacacuggaacaacaaagaagcccuagucgaguucaaagacgcacacgcaaaacgccaaacagugguaguccuggguucccaagaaggcgccguccacacagcccucgccggcgcccucgaagcagaaauggacggcgcaaaaggacgccuuagcuccggccaccuaaaaugcagacucaaaauggacaaacuccgccuuaaaggcguaucauacagccucugcacagcugcauucaccuucaccaaaauacccgccgaaacccuccacggaacagucaccgucgaaguacaauacgcaggaacggauggcccuugcaaaguaccagcccagauggccgucgacaugcagacccuaacaccagucggaagacucauaaccgccaauccagucauaacagaguccaccgaaaacuccaaaaugaugcucgaacuagacccuccauuuggcgacuccuacauagucauaggcguaggagaaaagaaaauaacacaccacuggcaccgcuccgguuccaccauuggaaaagcauucgaagcgacaguacgcggggcaaaacguauggcggugcucggcgacaccgccugggacuuuggguccgucggcggcgcccucaauucacucggcaaaggaauacaucaaaucuucggagcggccuucaaaucccuauucggcggcaugagcugguucucccaaauacugaucggcacacuacucauguggcuaggccucaacaccaaaaacggcucaaucucccucaugugccuggcacucggcggcguacucaucuuccuauccacagcagugagugccgacgugggaugcuccguagacuucucgaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4950 - RNA, 2359 nt, Artificial Sequence
  ZIKV (isolate Z1106033) Polyprotein(93-804) mRNA Design 1 opt
gggagaaagcuuaccaugcgcaucaucaacgcccgaaaagaaaagaaacgacgaggagcggacacgucagucggcaucguaggauuacugcucaccacagcaauggccgccgaagucacccgcaggggcagcgcauauuacauguaccuugaccgaaacgacgcgggggaagcaauaucguuccccaccacgcuaggcaugaacaaaugcuacauccaaauaauggaccuaggccauaccugcgacgccacaaugucauacgaaugcccaaugcuagacgaaggcguagaacccgacgacguagacugcuggugcaacacaacaagcacaugggucgucuacgggacaugccaccacaagaaaggcgaagcucgcagaagcagacgcgccgucacacugccaagccacuccacccgaaaacuacaaacccgcagccaaaccuggcucgaaagccgcgaauacacaaaacaccucauacgagucgaaaacuggaucuuccgaaaccccggcuucgcccuggcagcagcagccauagccuggcuccuaggcucaagcacaagccaaaaaguaauauaccuagucaugauccuacuaaucgcgccagcguacucaauccgaugcaucggugucagcaaccgagacuucgucgaaggcaugucagguggcaccugggucgaugucguccuggaacacggcgguugcgucacggucauggcccaggauaaaccuaccguagacauagaacuggucaccacgaccguaagcaacauggcagaagugaggagcuauugcuacgaagcaucaauaucggacauggccucugauucgcgaugcccgacccaaggcgaggcauacuuggauaaacaaucagauacccaauacguauguaaacgaacgcuaguagaccgagggugggggaacgguugcggacucuuuggaaaaggcucccuaguaaccugcgccaaauucgcguguucaaagaaaaugacaggcaaaucaauacagccagaaaaccucgaauaccggauaaugcucuccguccacgggucccaacacagcggcaugauagucaacgacacaggccacgaaacagacgaaaauagggccaaagucgaaauaacaccaaacucaccacgagcggaagccacgcucggcggauucggaucccuaggccucgacugugaaccccggaccggccuggacuuuagcgaccuauacuaccucacaaugaacaacaaacacuggcucguccacaaagaaugguuucacgacaucccccugccauggcacgcgggcgcagacacuggcacaccacacuggaacaacaaagaagcucuugucgaguucaaagacgcacacgccaaaagacaaacagucgugguacucggaucccaagaaggagccguacacaccgcccucgccggcgcccucgaagccgagauggacggugccaaaggacgccucagcagcggacaccuaaaaugcagacuaaaaauggacaagcucagacucaagggcguauccuacucccucugcaccgccgccuucaccuucacaaaaauccccgccgaaacccuacacgggaccgucaccgucgaaguacaguacgccggcacagauggccccuguaaaguaccagcccaaauggccgucgacaugcaaacccugacacccgucggacgccuaauaacggccaaccccgucaucaccgaaucaaccgaaaacuccaaaaugaugcucgaacuagacccacccuucggcgacagcuacaucgucaucggggucggagaaaagaaaauaacccaccacuggcaccgauccgggucaaccaucggcaaagcauucgaagccaccguccgcggcgcaaaacgcauggcgguccugggagacacagcuugggacuucggauccgucggcggcgcccuaaacucacucggaaaaggcauucaccaaaucuucggcgccgccuuuaaaagccucuucggcggaaugucgugguucucccagauccuuauaggaacccuacuaauguggcucggcuugaacgccaaaaacggaagcauaagucugaugugccucgcacucggaggcguccuaaucuuccuaagcaccgcaguaagcgccgacguuggauguaguguagacuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4951 - RNA, 2347 nt, Artificial Sequence
  ZIKV (strain MR 766) Polyprotein(93-800) mRNA Design 1 opt
gggagaaagcuuaccaugagaauaaucaacgcccgaaaagaacgcaaacgcagaggagccgacacaagcauaggcauuaucggccuacuucucaccaccgcaauggcugcagaaaucaccagacgaggaagcgccuauuacauguaucucgacagaucagaugcaggaaaggcaaucuccuucgccaccacacucggaguaaacaaaugccacgugcaaaucauggaccucggacacaugugcgacgcgacaaugucauacgagugccccaugcuagacgagggagucgagccagacgacguagacugcuggugcaacacaaccucaaccugggucgucuacggaacaugccaccacaaaaagggggaagcacgccgaagccgcagagcggucacacuaccaagucacuccacacgcaagcuccaaacccggagccagaccuggcuagaaucccgggaauacaccaaacaccuaauaaaaguagagaacuggauauuucggaacccaggauucgcgcucgucgccguagccaucgcauggcuacuaggcuccagcacaucacaaaaagucauauaccuuguaaugauccuccucaucgcccccgcauacuccauccgcugcauaggagucagcaaucgcgacuucgucgaaggcaugucaggaggaaccuggguagauguaguacucgagcauggcggcugcgucacagucauggcacaagacaaaccaaccguagacaucgaacucgucacaaccaccgugagcaacauggcugaaguccggucauacugcuacgaggcaucaauauccgacauggccuccgacagccgcugcccaacccaaggcgaagccuaccucgacaaacagagcgacacacaauacgucugcaaacgaacccucguagacagaggcugggggaacggaugcggacuauucggcaaaggaucccucguaaccugcgccaaguucacgugcagcaagaaaaugaccggcaaauccauucaacccgaaaaccuagaguaccgcaucaugcuaucaguccacggcagucaacacucagggaugaucggcuacgaaaccgacgaagaccgcgccaaaguggaagucacaccaaacucaccacgcgccgaagcaacacuaggcggguucggaucccugggacucgacugcgagccccgcacgggccuagacuuuagcgaccuuuacuaucuaaccaugaacaacaaacacuggcuaguacacaaagagugguuccacgacaucccacuaccguggcacgcaggggcagauaccggcacaccgcacuggaacaauaaagaagcccuaguagaguucaaagacgcacacgccaaacgacaaaccguaguggucuuaggaucccaggaaggagccguacacaccgcccucgccggagcccuagaagccgaaauggacggcgccaaaggccgccuauuuucgggccaccucaaaugccgccugaaaauggacaaacuacgccuaaaagggguaaguuacucccucugcaccgccgcauucacauucacuaaagucccagccgaaacccuccacggcacaguaacaguagaaguccaauacgccggaaccgacggacccugcaaaauccccguacaaauggcaguagauaugcaaacccuaacccccgucggccgccuaauaacagccaaucccguaauuaccgaauccacagagaacagcaagaugaugcucgaacuugacccacccuucggcgacucguacauagucaucggagucggcgacaagaaaauuacacaccacuggcaccggucaggaucgacaaucggcaaagcguucgaggcaaccguacgaggagccaaaagaauggccguacuaggugacaccgcgugggacuucggcuccguagggggcguauucaacucccuaggaaaaggaauccaccagaucuucggcgccgcauucaagucacuauucggggguaugagcugguucagccaaauccuaaucggcacccuacugguguggcucggucucaacaccaaaaacggaucaaucucccucacaugccuagcauuagggggagucaugaucuuccucagcacagcagucucagccgacgugggaugcagcguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4952 - RNA, 2359 nt, Artificial Sequence
  ZIKV (strain NatalRGN) Polyprotein(93-804) mRNA Design 1 opt
gggagaaagcuuaccaugagaaucaucaacgccaggaaagaaaagaaaagacgaggagcagauaccaguguaggcauaguaggcuuacuccucacuacagcaauggcagccgaaguaacaagacggggcuccgcguacuacauguaccucgaccgaaacgacgcaggagaggcgaucagcuuccccacgacgcuagggaugaacaaaugcuacauacaaaucauggaccucggccacaugugcgacgcaacaaugagcuacgaaugccccaugcuggaugaaggaguggagcccgacgacguagacugcuggugcaauaccacaaguaccugggugguguacggaacaugccaccacaagaaaggcgaagcccgacgaucgcgccgagccguaacucugccgucccauucgaccagaaaacuccaaacaagaucacagacauggcuagagucacgggaauauacaaaacaccucauccgcguagaaaacuggauauuccgaaacccgggcuucgcccucgcagcggcagcaaucgccuggcugcuggggaguucgaccagccaaaaagucauauaccuaguaaugauccuacucaucgcaccggcuuacagcauacgcugcauaggagucucaaaccgagacuucgucgaaggaaugagcggcggcaccuggguagacguaguacucgagcacggcgggugcguaaccgucauggcacaagacaaaccaacaguagacauugagcuagucacgacaacaguauccaacauggcugaaguaagaaguuacuguuacgaagccagcaucagcgacauggcaagcgacucucgcugccccacccaaggagaagccuaccucgacaaacagucagacacccaguacguauguaaacgaacgcuaguagacagaggcuggggcaacggauguggccuuuuuggaaaaggauccuuagucacaugcgccaaauucgccugcagcaagaaaaugacagggaaaucaauccagccagaaaaccuagaauaccggaucaugcucagcguccacggcucccagcacucgggaaugaucguaaacgacacaggccacgaaacagacgaaaaucgcgccaaaguagaaauaaccccgaacagcccccgcgcagaagccacucuaggagguuucggaagccucggucuagacugcgagccccgcaccgggcuagacuucagugaccuauacuaccugacaaugaacaacaaacacuggcuaguccacaaagaaugguuccaugacaucccacuaccguggcacgcaggcgcagauaccggcaccccacacuggaauaacaaagaagcccucgucgaguucaaagacgcgcacgccaaacgccaaacuguggucguacucgggagucaggaaggcgcaguacacaccgcacucgcaggcgcccuagaagcagaaauggacggcgcaaaaggacgccuauccagcggacaccucaaguguagacuaaaaauggacaaacuccgacucaaagguguaagcuacucccuaugcacggcagcauucaccuucacgaaaauaccagcggaaacacuccacggaacaguaacaguagaaguccaauacgcagggacugacgggccaugcaaaguacccgcgcaaauggcaguagacaugcaaacacucacaccggucggacgacuaauaacagcaaacccgguaaucaccgaaagcaccgaaaacagcaaaaugaugcucgaacuagacccacccuucggagacucauacaucgucaucggcguaggagaaaagaaaaucacgcaccacuggcacagaucaggaucgacuauaggcaaagccuucgaagcaacagucagaggggccaaacgcauggcaguacugggggacacagccugggacuucggguccgucggcggggcucuaaacagccuaggcaaagggauacaccaaaucuucggcgcagcauucaaaucacucuucggcggcaugagcugguucagccaaauccuaaucggaacacuacucauguggcuaggguuaaacaccaaaaacggcagcaucagccucaugugcuuagcccuaggcgggguacucauauuucuaagcacagcaguaagcgccgacguaggaugcagcguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4953 - RNA, 2284 nt, Artificial Sequence
  ZIKV (strain ZikaSPH2015) Polyprotein(108-794) mRNA Design 1 opt
gggagaaagcuuaccaugacguccguaggcaucguggggcuccugcuaacgacggccauggcagcagagguaacccgccgaggcucagcauacuacauguaccuagaccgaaacgacgcgggagaagccaucagcuuccccaccacccucggaaugaacaaaugcuacauccaaauaauggaccucggccacaugugcgacgcgacaaugucauacgaaugcccaauguuagacgaaggggucgaacccgacgacgucgacugcuggugcaacaccacaagcacauggguaguauacgguaccugccaccacaagaaaggcgaagccagacgcagccgcagagccguaacccucccgucccacagcacacggaaacuccagacacggagucaaacauggcuggaaucgcgcgaauacaccaaacaccuuauaagaguagaaaacuggaucuuccgaaacccgggcuucgcgcucgccgcagccgccaucgcauggcuccugggguccagcaccagccaaaaagucauauaccucgucaugauccuccucauagcccccgccuacuccauccgcugcaucgguguguccaaccgagacuucguagaaggaaugucgggaggaacauggguagacauaguccucgaacacggcgggugcgucaccgucauggcgcaagacaaaccaacaguagacauagagcuaguaacaacaacagucagcaacauggcugaaguccgauccuacugcuacgaagcaucaaucagcgacauggcaucugacagucgaugccccacacaaggugaagccuaccucgacaaacagucagacacacaauacguaugcaaacgcacacucguagacagaggcuggggcaacggaugcggacuguucggcaaaggcucacugguaacaugcgccaaauucgcaugcagcaagaaaaugacaggcaaaagcauccaaccagaaaaccuagaauaccgcaucaugcuaagcguccacggaagccaacacagcggcaugauagucaacgacaccgggcacgaaacagacgaaaaccgagccaaagucgaaaucacgccaaacagcccccgcgccgaagcaacacuaggcggcuucggaagccucggccuagacugcgaaccacgcacaggacuagacuucagcgaccuauacuaccucacuaugaacaacaaacacuggcuaguacacaaagaaugguuccacgacauaccccucccuuggcacgccggcgccgacaccgguacaccccacuggaacaacaaagaagcccucguagaguucaaggacgcucacgccaaacgacaaaccgucgucguucucggaucccaagaaggcgcaguacacacagcacuagccggcgcccuagaagcugaaauggacggagccaaaggacgccuaucaucaggacauuuaaagugccgccucaaaauggacaaacuccgacucaaaggagucuccuacagccugugcacagcagccuucacauucacaaaaauacccgcagagacccugcacggaaccguaaccguagagguccaauaugccggaaccgacggccccugcaaagucccagcccaaauggcagucgacaugcaaacacucacccccguaggaagacuaaucaccgcaaacccaguaaucaccgaaaguaccgaaaacagcaaaaugaugcuagaacucgaucccccauucggcgacagcuacauagucaucggggucggcgaaaagaaaaucacccaccacuggcaccgcucaggaucaacaauaggaaaagcauucgaggcaaccguacgcggcgccaaacgcauggccguccuaggagacacagcaugggacuuuggcuccguaggaggcgcgcucaacagccucggaaaaggaauacaccaaaucuucggggccgccuucaaaucccuauuuggaggaaugucgugguucucgcaaauccucauaggcacacuccugauguggcucgggcuaaacaccaaaaacggcuccaucagucuaaugugucucgcccucggaggaguccuaaucuuccuaagcacagcuguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4954 - RNA, 2284 nt, Artificial Sequence
  ZIKV (isolate Z1106033) Polyprotein(108-794) mRNA Design 1 opt
gggagaaagcuuaccaugaccagcgucggaauuguaggacugcuccuaacgacagcaauggcagccgaaguaaccagaagaggcuccgcauauuauauguaccucgaccggaacgacgccggagaagccaucuccuucccaaccaccuuagguaugaacaaaugcuacauccaaaucauggaccucggacacacgugcgacgcaaccauguccuacgaaugcccaaugcuagacgaaggcguagaaccagacgacguagacugcuggugcaacaccaccucgacuuggguaguauacggaaccugccaccacaaaaagggcgaagcacgccgaucacgcagagccgucacccuccccucacacagcacccgaaaacugcaaacacggucccaaaccuggcucgaaagccgagaauauacuaaacaccucauaagaguagagaacuggauuuucagaaacccgggcuucgcccucgccgcggcggcaauagcauggcuccuaggcuccuccacaucgcaaaaagugauauaucucgucaugauacuacucaucgccccagcauacuccauacgaugcaucggcguauccaauagagacuucgucgaaggaaugagcggaggcacguggguggacguaguccucgaacacggcggcugcguaaccgucauggcacaagauaaaccaacgguagacaucgaacucgucacaaccaccguaucaaacauggcugaaguccgauccuacugcuacgaagccuccaucagcgacauggcauccgacucacgcugccccacccaaggcgaggccuaccuggacaaacaaucagacacccaauacgucuguaagcgcacccugguggaccggggcuggggcaacgggugcggacucuucggcaaaggcagccucguaacaugcgcaaaauucgccugcagcaagaaaaugacaggaaaaagcauccaacccgaaaaccucgaauaccgaauaaugcuaagcguacacggaucccaacacuccgguaugauaguaaacgacacaggccacgagaccgacgaaaaccgcgccaaagucgaaauuacccccaauucgccccgagcagaagcuacccuaggaggguuuggcucccuaggacuggacugcgaaccacgcaccggacuagacuucuccgaccuauacuaccucaccaugaacaacaaacauuggcuaguacauaaggaaugguuccacgacaucccacuacccuggcacgccggagccgacacaggcacaccccacuggaacaacaaagaggcacucguagaguucaaagacgcccacgccaaaagacaaaccgucgucguucucggcucacaagaaggcgccguacacacggcccucgcuggugcccuggaagccgaaauggacggagccaaaggacgccucuccagcggccaccuaaaaugccgccuaaaaauggacaaacuccgccucaaaggcguauccuacucacucugcaccgccgccuucaccuucaccaaaauacccgcagaaacgcuccacggcacaguaaccgucgaaguacaguacgcuggaacggauggucccugcaaaguacccgcccaaauggcaguagacaugcaaacccucacccccguaggccgccucaucaccgccaacccaguaaucacagaaucaaccgaaaacucgaaaaugauguuagaacucgacccacccuucggagacucauacaucgucaucggcgucggcgagaaaaagaucacgcaccacuggcaccgcagcggcucaacaaucggaaaggccuucgaagcaaccguaagaggagccaaacgcauggccguacucggcgacaccgcaugggacuucggcuccgucggcggagcacuaaacucccucggcaaaggaauccaccaaaucuuuggcgcagcuuuuaaaucccucuucggcggcaugucaugguucucucaaauccucaucggcacacuccuaauguggcucggguuaaacgcuaaaaacggcuccaucagccucaugugccuagcacucggcggaguacuaauauuccuaucaaccgcaguaucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4955 - RNA, 2272 nt, Artificial Sequence
  ZIKV (strain MR 766) Polyprotein(108-790) mRNA Design 1 opt
gggagaaagcuuaccaugacauccauaggcaucauaggauuacuacuaaccaccgccauggccgccgaaauaacacgccggggauccgcuuacuauauguaccucgaccgcagugacgccggcaaagcuaucagcuucgcaaccacucuaggaguaaauaaaugccacguucaaaucauggaccuaggccacaugugcgacgccacaauguccuacgaaugccccaugcuagacgaagguguagagccggacgacgucgacugcuggugcaauaccaccagcaccugggucgucuacggcacgugccaccacaagaaaggagaagcacgucguucccgacgcgccguuacucugccaagccacuccacccguaaacuccagaccagaucacaaacauggcuagaguccagagaauacaccaaacaccucaucaaagucgagaacuggauauuccgaaaccccggcuucgcccucgucgccgucgcaaucgccuggcuacucggauccagcacuucacagaaagucaucuaccucgucaugauccuacucaucgccccggcuuacagcauccgaugcaucggagugagcaaccgugacuucgucgaaggcaugucuggcgguaccuggguagacgucguccuagaacacggaggcugcgucaccguaauggcccaagacaaacccacugucgacauagaacucgucacaacaaccgucagcaauauggcagaaguccgcuccuacugcuacgaggccuccauaagcgacauggcaucagacucccgcugcccaacccaaggagaagccuaccuggacaaacaauccgacacgcaauacgucugcaaaagaaccuuagucgaccgcggauggggaaacgggugcggccuauucggcaaaggcucgcucguaaccugcgccaaguucacaugcagcaaaaagaugacgggcaaaagcauacaaccggaaaaccucgaauacagaauaaugcucucgguccacggcucccaacacagcggaaugauuggauacgaaacugacgaggacagagccaaagucgagguaaccccaaacuccccgcgcgcugaagccacccuaggaggcuucggaagccugggccuugacugcgaaccccgaacaggacuggacuucucagaccuguacuacuugaccaugaacaacaaacacuggcugguccauaaagaaugguuccacgacaucccccuuccauggcaugcaggcgcagacaccggcacaccccacuggaacaacaaagaagcccucgucgaguucaaggacgcacacgcaaaacgucaaaccguugucguccuaggcucacaagaaggagcaguucacaccgcccucgcgggcgcccuagaggcagaaauggacggagccaaagggcgccucuucagcggccaccuaaaaugccgccuaaaaauggacaaacuccgccugaaaggaguaucguacucccucugcaccgcagcauucaccuucaccaaaguacccgcggagacccuacacggaacaguaaccguugagguccaauaugccggaaccgacggcccaugcaagauccccguacagauggccguagacaugcaaacacugacaccagucggacgccuaaucaccgcaaaccccgugaucacagaguccaccgaaaacagcaaaaugaugcucgagcucgacccaccuuucggcgacagcuacaucgucauaggagucggagacaagaaaauaacccaccacuggcaccgaagcggguccacgaucggcaaagccuucgaagcgacaguuagaggagccaaacguauggccguacuuggcgacaccgccugggacuucggaagugucggcggcgucuucaacucacucggcaaaggaauccaccaaaucuucggagccgcguucaaaucacuauucggaggaauguccugguucucccaaauccuuauaggaacacuccugguauggcuaggucuaaacaccaaaaacggcagcauaucccuaaccugccucgcgcucggcggugucaugauauuccucucuaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4956 - RNA, 2284 nt, Artificial Sequence
  ZIKV (strain NatalRGN) Polyprotein(108-794) mRNA Design 1 opt
gggagaaagcuuaccaugaccaguguaggcaucgucgggcuccuacucaccacggccauggcggcagaggucacccgacguggauccgcauauuacauguaccucgaccgaaacgacgccggggaagcgauauccuucccgaccacccucggaaugaacaaaugcuacauacaaaucauggaccuaggacacaugugcgacgcaacaaugagcuacgaaugcccaaugcucgacgaaggcguggaaccagacgacgucgacugcuggugcaacaccaccuccacauggguaguauacggcacaugccaucacaagaaaggcgaagcccgacgguccagacgcgcugugacacucccaagccacagcacaagaaaacuccaaacacgcucccagaccuggcucgaaagccgggaauauacaaaacaccucauacgcgucgaaaacuggauauuccgcaacccgggguucgcacucgcggccgccgccaucgcauggcuccuuggcagcagcacuucacaaaaagugauauaccucguaaugauccuccugaucgcgcccgccuacuccauccgcugcauaggcgucagcaaccgcgacuucguggaaggaauguccggcggcacgugggucgacgucguacucgaacacggaggcugcgucacaguaauggcccaagacaaaccaacggucgacaucgaacuuguaaccaccacaguaagcaacauggccgaaguccgcucauacugcuacgaggcaagcauauccgacauggcaucagauucacgcugccccacccaaggagaagccuaccuggacaaacaaucagacacacaauacguaugcaaacggacccucguagaccgcggcuggggcaacggcugcggacucuuuggcaaagguucgcucguaaccugcgccaaauucgccugcuccaaaaagaugaccggaaagucaauccaacccgagaaccucgaauaccgaaucaugcucucgguccacgggucccaacacaguggcaugaucgucaacgacacgggacacgaaacagacgagaacagagccaaaguagaaaucacccccaacuccccaagagcggaagcaacacucggcggcuucggcagccuuggccuagacugcgaaccacgaaccggacuggacuucagugaccucuauuaccuaacaaugaacaauaaacacuggcucguacacaaagaaugguuccacgacauaccgcuacccuggcacgcgggugccgacaccggaaccccacacuggaauaacaaggaagcccuagucgaauuuaaagacgcacacgccaagagacaaacagucguaguacuaggcucacaagaaggcgcaguacacacagcccuagcaggagcgcucgaagccgaaauggacggcgcgaaaggccgacugagcagcggccaccuaaaaugccgacuaaaaauggacaaacuacgccuuaaaggagugucauacagccucugcacagcggcauucaccuucaccaagauaccugcagaaacacuucacggcaccguaaccgucgaaguacaauaugccggaacagacggcccaugcaagguacccgcgcaaauggccgucgacaugcaaacccuaacccccguaggacgacuaaucacagcaaaccccgucaucaccgaaucgacagaaaacucaaaaaugaugcuagaacuagaucccccauucggcgacucauacauagucauaggcgucggcgaaaagaaaaucacacaccauuggcaccgauccggaagcacaauaggaaaagcauucgaggcaacaguaagaggcgccaaacgcauggcaguccucggcgacacagcaugggacuucggcagcguaggaggagcacuaaacucccugggaaaaggaauacaccaaauauucggcgccgcauucaaaagccucuucggagggaugagcugguucucccaaauccuaaucgggacccuccugauguggcuaggccuaaacaccaaaaacgggagcaucagccucaugugccuagcacuaggcggcguccuaauauuccuaucaaccgcaguuagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4957 - RNA, 1576 nt, Artificial Sequence
  ZIKV (strain ZikaSPH2015) Polyprotein(273-723) mRNA Design 1 opt
gggagaaagcuuaccaugucacaaaaagucauauaccuggucaugauccuacucaucgccccagccuacagcauacgcugcauaggaguaucgaaccgagacuuugucgagggcaugagcggaggcacaugggucgacaucguccucgaacacggcgggugcgugacaguaauggcacaagacaaaccgacaguggacauagagcuagucacaaccacggucucgaacauggcagaaguaaggagcuacugcuacgaagccagcauaagcgacauggcaucagacucaaggugcccaacacaaggcgaggcuuaccucgacaaacaaagcgacacccaauacgugugcaaacgcacccuaguagaccgcgguuggggcaacggaugcggccuguucggcaaagggagccuagucacaugcgcgaaauucgccugcagcaagaaaaugacuggaaaaagcauccagccggaaaaucucgaauaccgcauaaugcucagcgugcacgggagccaacacucaggaaugaucgugaacgacaccggacacgaaacagacgaaaacagagcgaaaguagaaauaaccccaaacucaccaagagccgaagccacacuaggaggauucggcucgcuaggccuugacugcgaaccccgaaccgggcuagacuucucggaccucuauuaccucaccaugaacaacaaacacuggcucguccacaaagaaugguuccacgacauaccgcuacccuggcacgcaggcgcagacacaggcacaccccacuggaacaacaaagaggcccucguagaauuuaaagacgcccacgcaaaacgccaaacaguggucguacuagggagccaagaaggggcaguucacacggcccuagccggagccuuagaggcggaaauggacggagcgaaaggacgccucucgagcggccaucuaaaaugucgccugaaaauggacaaacucaggcucaaaggcguauccuacagccuauguaccgccgcguucacauucacaaaaauacccgcagaaacgcuacacggcacaguaacagucgagguacaauacgcaggcacagacgggcccugcaaaguacccgcgcaaauggcgguagacaugcaaacccuaacacccgucggcagacuaauaaccgcaaacccaguaaucacagagagcacagagaacagcaaaaugaugcucgagcucgacccaccguucggagacucauacauagucauaggcgugggcgaaaagaaaauaacgcaccacuggcaccgcuccggaucaaccauaggcaaagccuucgaagccaccguacgaggcgccaaaagaauggccgugcucggagacacagccugggacuucggcucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4958 - RNA, 1576 nt, Artificial Sequence
  ZIKV (isolate Z1106033) Polyprotein(273-723) mRNA Design 1 opt
gggagaaagcuuaccaugucccaaaaagucauauaccuaguaaugauacuacucauagccccagcauacagcauccgcugcaucggcguaucaaacagggacuucguagaaggcaugagcggaggaacauggguagacguaguccuagaacacggcggaugcgugaccguaauggcacaagacaaaccgaccguagacauagagcuagucaccacaaccgucuccaacauggcagaagucagaagcuacugcuacgaagcaagcaucagcgacauggccagcgacagccggugcccgacccaaggggaagccuaccuagacaaacagagcgacacacaauacgugugcaaacgcacacucguagaccgcggauggggcaacggcugcggacuguucggcaaaggaagucuagucacgugcgcaaaauucgccugcagcaagaaaaugaccggcaaaucgauccaacccgaaaaccucgaauaccgcaucaugcuaagcgugcacggcagucagcacucggguaugaucgugaacgacacaggacacgaaacagacgaaaaucgcgcaaaaguggaaauaaccccaaacucccccagagccgaggccacccucggaggcuucggcucgcucggacucgacugcgaaccccggaccggccucgacuucuccgaccuguacuaucuaacgaugaacaauaaacacuggcucguacacaaagaaugguuccacgacauacccuuacccuggcacgccggcgcagacacaggaacgccacacuggaacaacaaagaagcccucguggaguucaaagacgcacacgccaagcgccaaaccgucguaguacuaggaucccaagaaggcgccguacacacggcccuagccggagcccuggaagcggaaauggacggagcaaaaggcagacucagcagcggacaccugaaaugccgacugaagauggacaaacuaagacucaaaggcgugagcuacagccucugcacagccgcauucacguucacaaagauacccgcagaaacacuacacggcacaguaacagucgaaguccaauacgccggcacggacgggcccugcaaaguacccgcacaaauggcaguggacaugcaaacgcucacacccgugggaagacuaauaacagcaaacccagucauaacagaaagcacagaaaacagcaaaaugaugcuagaacucgacccacccuucggcgacucguacauagugauaggcguaggagaaaagaaaauuacacaucacuggcaccgcucaggcagcacaauaggcaaagccuucgaagcaacgguccgcggagcaaaacgcauggccgugcucggagacaccgccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4959 - RNA, 1564 nt, Artificial Sequence
  ZIKV (strain MR 766) Polyprotein(273-719) mRNA Design 1 opt
gggagaaagcuuaccaugucgcaaaaaguaaucuaccuagucaugauccuacuaaucgcccccgccuacuccauacgaugcaucggaguaagcaacagagacuucgucgaaggaaugagcggcggaaccugggucgacguaguccuggaacauggcggcugcgucaccgucauggcccaagacaaacccaccguagacauagaacucgucacaacaacaguauccaacauggcugaaguccgaagcuacugcuacgaagccucaauaagcgacauggccucagacagcagaugccccacccaaggagaagcauaccuagacaaacaaagcgauacacaauacguauguaaacgcacacuggucgaccgcggauggggaaacggcugcggccucuucggcaaaggcagucucguaaccugcgccaaauucacaugcagcaagaaaaugaccggaaaauccauacaaccugaaaaccucgaauauagaaucaugcuaucgguccacggaagccaacauucgggcaugaucggcuacgaaaccgacgaagaccgcgccaaaguagaagucacaccgaacaguccccgagcagaagccacccuaggcggcuucggaucccucggccuagacugcgaacccagaaccggauuagacuucagcgacuuauacuaccucaccaugaacaacaaacacuggcucguccacaaagaaugguuccacgacauaccccuaccauggcacgccggcgcagacaccggcaccccgcacuggaacaacaaagaagcccuagucgaguucaaagacgcacacgccaaacgccaaaccguagucguacucggaagccaagaaggcgcaguacacaccgcccuggccggagcccucgaagccgaaauggacggcgccaaagggagacucuucagcggacaccuaaaaugcagacucaaaauggacaaacuccgccuaaaaggcguguccuacucccuaugcacagcagccuucacguucacaaaagugccagccgaaacacuacacggcacaguaaccgucgaaguccaauacgcgggaacagacggcccaugcaaaaucccaguccaaauggcagucgacaugcaaacacucacccccgucggacgacuaaucaccgccaacccagucaucaccgaauccacagaaaacucaaaaaugaugcucgaacucgacccacccuucggagacuccuacaucgucauaggagucggcgacaaaaagaucacccaccacuggcacagaagcggcagcaccauaggcaaagccuucgaagcaacaguacgcggagcaaaacgcauggccguccuaggcgacaccgccugggacuucggguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4960 - RNA, 1576 nt, Artificial Sequence
  ZIKV (strain NatalRGN) Polyprotein(273-723) mRNA Design 1 opt
gggagaaagcuuaccaugagccaaaaagucauauaccucguaaugauccuacucauagccccggccuacagcauccgcugcaucggaguaucaaacagagacuucguagaaggcaugagcgggggaacauggguagacguaguccucgaacacggaggaugcguaacaguaauggcacaagacaaaccgaccguagacauagaauuagucacaaccacagucucaaacauggccgaaguccgcagcuacugcuacgaagcgagcauaagcgacauggcaagcgauucaagaugccccacccagggggaagccuaccuagacaaacaaagcgacacccaguacguaugcaaacgaacccucguggaccgcggauggggaaacgguugcggccuauucgggaaagggagccuagucacaugcgcaaaauucgcaugcagcaagaaaaugaccgggaaaagcauacaaccagaaaaccuagaauaccgcaucaugcugagcguacacgggagccaacacucaggaaugaucgucaacgacaccggacacgaaacagacgaaaaccgagccaaaguagaaauaaccccuaacucaccacgagccgaagcgacacugggcggauucggcucgcucggacuugacugcgaaccccggaccggacuagacuucucggaucuauacuaccucacgaugaacaacaaacacuggcucguacacaaagaaugguuccacgacauaccccuacccuggcacgcgggcgccgacacaggaacaccccacuggaacaacaaagaagcacucguagaguucaaagacgcacacgccaaacgccaaaccguagucguacuaggaagccaagaaggcgccguccacacggcacuagccggagccuuagaagccgaaauggacggcgccaaaggccggcuaucaagugggcaccugaaaugcagacugaaaauggacaaacucaggcucaaaggagugagcuacagccugugcacggcagcauucacauucacaaaaauaccagcggaaacacuccacgggaccgucacggucgaaguccaauacgcaggcacagacggacccugcaaaguacccgcgcaaauggccgucgacaugcaaacgcucacaccaguaggcaggcucauaacagcaaacccaguaauuaccgaaagcacagaaaacagcaaaaugaugcuagaacucgacccaccauucggagacucauacauagucaucggcguaggagagaagaaaauaacacaccacuggcaccgaucaggcuccacaaucggcaaagccuucgaggcaaccgucagaggagccaaacgcauggcagugcucggagacacggccugggacuucggcucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4961 - RNA, 2284 nt, Artificial Sequence
  ZIKV (strain ZikaSPH2015) Polyprotein(108-794)(F398S) mRNA Design 1 opt
gggagaaagcuuaccaugacaagcguaggcauagucggcuuacugcucacgaccgccauggcagcggaaguaaccagacgaggaagcgcauacuauauguaucuggaccgaaacgacgccggcgaagcaaucagcuuccccacaacgcucggcaugaacaaaugcuacauacagaucauggaccucgggcacaugugcgacgccacgaugaguuacgagugccccaugcucgacgagggagucgaaccagacgacgucgacugcuggugcaacaccaccagcaccugggugguauacggcacaugccaccacaagaaaggagaagcacgccgcucucgacgagccguaacacuccccucccacagcaccagaaaacuccagacaagaucacaaacauggcuagaaucacgcgaauacacaaaacaccucauaagggucgaaaacuggauauucagaaaucccggauucgcccucgccgccgccgcgaucgcaugguuacucggcuccuccaccagccaaaaagucauauaccuagugaugauacuccucaucgcuccagcauacuccauccggugcauaggaguauccaaccgagauuuuguggagggaaugucgggaggcaccugggucgacaucguccucgagcacggaggcugcguaacagucauggcacaagacaaacccacagucgacauagagcuaguuaccacaaccguauccaacauggccgaaguaagaucguacuguuacgaagcaagcaucagcgacauggccagcgacagccgcugcccuacccaaggcgaagccuaccucgacaaacaguccgacacacaauacguauguaaacgcacccuagucgacagagguugggguaacggcugcggacucagcggcaaaggcagccucgugaccugcgcgaaauucgccugcucaaagaaaaugaccggcaaauccauacaacccgaaaaccuagaauaccgcaucaugcucucgguccacggaucacagcacucaggcaugauagucaaugacacaggacacgaaaccgacgaaaaccgagcuaaagucgaaaucaccccaaacagcccacgcgccgaagccacgcucggaggcuucggaucacuagggcuagacugcgaaccccgcacaggacuagacuucagcgaccucuacuaccugacaaugaacaacaaacacuggcucguucacaaagaaugguuccacgauaucccccuacccuggcacgcaggagccgacacaggaaccccacacuggaacaacaaggaagcccucguagaguucaaagacgcacacgccaagcgacaaaccgucguaguauuaggcucgcaagaaggcgcaguacacacagcccucgccggcgcacucgaagcagaaauggacggcgccaaagggcgacuaaguagcggccaucucaaaugccgacucaaaauggacaaacuccgacuaaaaggcgucucauacucccuaugcaccgcagcauucaccuucaccaaaaucccggccgaaacacuccacggaaccgucaccgucgaaguacaauacgcaggaacggauggcccguguaaaguucccgcgcaaauggccgucgacaugcaaacgcuuacaccagucggcagacucauaacagccaacccaguaauaaccgaaagcacagaaaauagcaagaugaugcucgaacuagacccacccuucggagacuccuacauaguaaucggcguaggagaaaagaaaaucacccaccacuggcaccgaagcggaagcacgaucggcaaagcauuugaagccaccgugcgcggcgccaagagaauggccguacucggcgacacagccugggacuucgguuccgucggaggcgcacuaaacucacugggcaaaggcauacaccaaaucuuuggagcagccuucaaaagccucuucggaggcaugucaugguucucccagauacucaucggcacccuacucauguggcuaggccugaacaccaagaacgggucaauaucacuaaugugccuagcccucggcggaguacuaauauuccugagcaccgccguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4962 - RNA, 2284 nt, Artificial Sequence
  ZIKV (isolate Z1106033) Polyprotein(108-794)(F398S) mRNA Design 1 opt
gggagaaagcuuaccaugacgagcgucggcaucgucggacugcuucucacaaccgcgauggcagccgaaguaacccgcagaggauccgcauacuacauguaccuagaccgaaacgacgccggagaagccaucagcuucccaaccacccugggaaugaauaaaugcuacauacagaucauggaccugggccauaccugcgacgcgaccauguccuaugagugcccaaugcuagacgaaggaguagagcccgaugacgucgacugcuggugcaacacaacuucgaccugggucguguacggaaccugccaccacaagaaaggcgaagcacggcgaucaagacgagccgucacacuaccaagccacagcacccgcaagcuacaaacacgaagccagacauggcuagaaucccgagaguacaccaaacaccuaauccgaguagagaacuggaucuuccgcaacccaggcuucgcacuugccgcggccgcaaucgccuggcugcucggcagcagcacaagucaaaaggucaucuaccuggucaugauacuccuaauagcgccggccuacagcauccguugcaucggcgucuccaaccgagacuucguugaaggcaugucaggaggcacauggguagacguaguacucgagcacggaggcugcguaaccgugauggcgcaggacaaaccaacaguagacaucgagcuagucaccacaaccgugucgaacauggcugaagucaggagcuacugcuaugaagcaucaauaucagacauggcaagcgacuccagaugccccacacaaggcgaagccuaccucgacaaacaaucugacacccaauacgugugcaaaaggacccuaguagaccggggcuggggcaacgggugcggccuaagcggcaaaggcagccuaguaaccugcgccaaauucgcaugcuccaagaaaaugacaggcaaauccauccaaccagaaaaccuagaauacagaaucauguuaucaguccacggaagccaacacucaggcaugaucgucaacgacaccggacacgaaacagacgaaaaccgcgcgaaaguagaaauaaccccaaacucacccagagcagaagccacacugggcggcuucggcucccucggacuggacugcgaaccccgaaccgggcuagacuucucagaccuauacuaccucacaaugaacaacaaacacuggcucguccacaaagaaugguuccacgacaucccacuccccuggcacgcaggcgccgacaccggcacaccacacuggaauaacaaagaagccuuaguggaguucaaagacgcacaugccaaaagacaaaccgucgucguacuaggcagucaagaaggcgcaguacacacagcgcucgcgggcgcgcuggaagccgaaauggacggagcaaaaggcagguuaucaagcggccaccucaaaugccgacuaaaaauggauaaacuacgccucaaaggcguaagcuacagccucugcacagcagcauucaccuucaccaaaauacccgccgaaacacugcacggcacaguaacagucgaaguccaauacgcaggcaccgacggaccaugcaaaguccccgcccagauggccgucgacaugcaaacccucacucccguagggcgcuuaaucaccgccaacccagucaucacagaauccacagaaaacaguaaaaugaugcucgaacucgacccgccuuucggagacuccuacaucguaaucggcguaggcgaaaagaagaucacccaucacuggcacagaucagguagcaccaucggcaaagcguucgaagcaaccgugcgcggcgcgaaacgcauggcaguucucggcgacacugcaugggacuuuggcucaguaggaggcgcacucaacagccuaggaaaaggaauacaccaaauauucggcgccgcauucaaaagccuauucggcggaaugucaugguucagccaaauacucauuggcacccuccucauguggcugggccucaacgccaaaaacggcuccauaucgcucaugugccucgcacuaggcggcguauuaauauuccucucaacagcugucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4963 - RNA, 2272 nt, Artificial Sequence
  ZIKV (strain MR 766) Polyprotein(108-790)(F398S) mRNA Design 1 opt
gggagaaagcuuaccaugaccuccauaggcauaaucggccuacugcuuacgacagcaauggccgcagaaauaacacgacggggcuccgccuacuacauguaccucgaccgcucggacgccggaaaagcaaucaguuucgcuacaacccucggcguaaacaaaugccacguccaaaucauggacuuaggccacaugugcgacgcgacuauguccuacgaaugccccauguuagacgagggcgucgaacccgacgacgucgacugcuggugcaacaccaccucgacauggguagucuacggcacuugccaucacaagaaaggagaagcacgccguucaagacgagcagucacccuacccagccacagcacacgaaaacuacaaacccgcucccaaaccuggcuagaaagccgcgaauacaccaaacaccucauaaaagucgaaaacuggauauuccgaaaccccggcuucgcacucgucgccguagccaucgcauggcuccuaggauccagcaccagccagaaagucauauaccuagucaugauucuacucaucgcaccggcauacuccauacgcugcaucggaguaagcaacagagacuucgucgaagguauguccggcggcacuugggucgacgucguccucgaacacggaggaugcgugacagucauggcacaagacaaaccaacaguggacaucgaacucguaaccaccaccgucagcaacauggccgaaguccgaagcuacugcuacgaagccagcaucagcgacauggcuucagacagccgcugcccaacgcaaggggaagccuaccucgacaaacaaucagacacccaauacguaugcaaacgcacccuggucgaucgcggauggggcaacgggugcggccuuucuggcaaggggucccuaguaaccugcgcaaaauucaccuguucaaagaaaaugaccggcaaauccauccaaccugaaaaccucgaauaccguauaaugcucaguguccacggaucccaacacagcggaaugaucggcuacgaaacagacgaagaccgcgccaaaguagaaguaacccccaacucgccacgagccgaggccacacuaggcgguuucggcucccuaggacucgacugcgaaccucgcacagggcucgacuucuccgaccuauacuaccugacaaugaacaacaaacacugguuaguccauaaggaaugguuccaugacauaccccuccccuggcacgcuggcgccgacacaggcacaccgcacuggaacaacaaagaagcucuaguagaauuuaaagacgcccacgccaaacgacaaacagucguuguccuaggcucccaagagggagcaguacacacagcccuagcgggcgcccuagaagccgaaauggacggcgccaaaggccgccucuucuccggccaccucaaaugucgccucaagauggacaaacuccgccuaaaaggcguaucuuauagccuaugcacagcagcauucacauucacaaaaguaccagccgaaacgcuccacggaacggucacagucgaaguccaauacgccggcaccgacggaccgugcaagaucccaguacaaauggcaguagacaugcagacccuaacaccagucggccgccugauaacugccaacccagucauaaccgaaucgaccgaaaacucaaagaugaugcuugagcuugacccacccuucggcgacuccuacauuguaaucggcgucggggacaagaaaaucacccaccacuggcacagaagcggauccaccauaggaaaagccuucgaagcaaccguaagaggagccaaaagaauggcaguccucggcgauacagcuugggacuucggaagcgucggaggcgucuucaacucccucgguaaaggcauccaccaaauauucggcgcagcauucaagucccuguucggcggaaugucaugguucucacagauacuaaucggaacacugcuaguauggcuaggccucaacaccaaaaacggcagcaucagccuuacgugccuagcacugggcggagucaugaucuuucucuccaccgccguauccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4964 - RNA, 2284 nt, Artificial Sequence
  ZIKV (strain NatalRGN) Polyprotein(108-794)(F398S) mRNA Design 1 opt
gggagaaagcuuaccaugacaucaguagggauaguaggacuccuccugacaacagccauggccgccgaagucacaagacguggcagcgcguacuacauguaccuggauagaaacgacgcaggcgaagcaaucaguuuccccacaacacugggcaugaacaagugcuacauccaaaucauggaccugggccacaugugcgaugccaccaugagcuacgaaugccccaugcuagacgaaggcgucgaacccgacgacgucgacugcuggugcaacacaacaaguacgugggucguguacggcacaugucaccacaaaaagggagaagcucggcggucccgccgagccgucacgcuccccagccacagcacaagaaaacuccaaacacgaagccaaacauggcuagaaucaagagaauacaccaaacaccucauaagaguggaaaacuggaucuucagaaacccaggcuucgcacuagccgcagccgcaaucgcgugguuacuuggcuccagcacuucucagaaagucauauaccugguaaugauacuacuaauagccccggcauacucgauacgaugcaucgggguaaguaacagggacuucgucgaaggaauguccggaggcacauggguagacguaguccuagaacacggcggaugcguuacgguaauggcccaagacaaaccaaccguagacaucgaacuggucacaacaaccguaagcaacauggcagaggucagaagcuacugcuacgaagccucaauaagcgacauggcaagcgauucccggugcccaacucaaggggaagcauaccuagacaaacaauccgacacacaauacguaugcaaacgcacacuuguagacagaggcugggggaacggcugcggacuauccggaaaaggcucguuagugacaugugcaaaauucgcaugcagcaagaaaaugacagggaaaucaauacaacccgaaaaccuagaauaucggaucaugcucuccguacacggcucacaacacagcggaaugaucguaaacgacaccggacacgaaacagaugaaaaccgagcuaaaguagaaaucacccccaacagcccaagagcagaagcaacacucggaggauucgguucacuuggacucgacugcgagcccagaaccggccucgacuucucagaccuauacuaccuaacgaugaauaacaaacacuggcucguacacaaagaaugguuccacgacauaccccugccguggcacgcaggggcggacacaggaaccccacacuggaacaacaaagaagcgcuggucgaguucaaagacgcccacgcuaaacgccaaaccguaguaguacucggaagccaggaaggagccguacacaccgcccuggccggggcacucgaagcagaaauggacggcgccaaaggccgccuaagcagcggacaccuaaaaugccgucugaaaauggacaaauugcgacucaagggaguauccuacucccuuugcaccgcagcauucacauucacaaaaauacccgccgaaacacuacauggcacaguaacaguagagguccaauacgcaggcacggacgguccaugcaaaguacccgcgcaaauggccgucgacaugcaaacacugacuccagucggcagacucauaaccgcaaaccccguaauaaccgaaaguaccgaaaacagcaaaaugauguuagagcuagacccacccuucggcgacagcuacauaguaauaggagucggcgagaaaaagauaacccaccacuggcaccgcagcggaagcaccaucggcaaagccuucgaagccacaguccgcggggccaaacgaauggcaguccugggcgacacagcaugggacuucgggucagucggcggcgcacuaaacagccucgggaaaggcauacaccaaaucuucggugcagcuuucaaaagccuauucggugggaugucaugguucagccaaauacucauaggcacccuccucauguggcugggccucaacaccaaaaacggcucaauaagccuaaugugccuagcacuaggcggcguccugauauuccuguccacagccguauccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4965 - RNA, 2284 nt, Artificial Sequence
  ZIKV (strain ZikaSPH2015) Polyprotein(108-794)(N444Q) mRNA Design 1 opt
gggagaaagcuuaccaugaccagcgucggaauagucggacuccuccucacaacagcaauggccgcggaagucacccgacgcggcagcgcuuacuacauguaccucgaccgaaacgacgccggcgaagccaucagcuuccccaccacccugggcaugaacaaaugcuacauacaaauaauggaccuuggccacaugugcgacgcgaccaugagcuacgaaugccccaugcucgacgaaggaguggagccagacgauguagacuguuggugcaacacaacaucaaccugggucgucuacggcacaugccaccacaagaagggagaagccagacgcagccgcagagcaguaacccuaccgucccacucuaccagaaaacuccaaacacgaagccagacaugguuagaaagccgcgaauacacaaaacaccucaucagagucgagaacuggauauucagaaacccaggcuucgcauuagccgcagccgcaaucgccuggcuccuagggagcucaaccucacaaaaaguaauauaccuagucaugauacuacucauagccccggccuacagcauacgaugcauaggugucucaaacagggacuucgucgaaggcaugagcggaggcacguggguggacauaguacucgaacacggcggcugcgugaccgucauggcacaagacaaaccgacaguagacauagaauuggugacaaccacagucuccaacauggccgaagugcguucauacugcuacgaagcaagcaucagcgacauggccucagacagccgaugcccaacccaaggcgaagccuaccuagacaagcaaagcgacacacaauacgucugcaagcggacgcuaguggaccgaggcuggggcaacggcugcggacuauucggcaaaggaagccucguaacaugcgcgaaauucgcgugcagcaagaaaaugaccggcaaauccauccaacccgaaaaccucgaauacagaauuaugcucuccguacacggcagccaacacuccggcaugauuguacaagauacaggccacgagacagacgaaaacagagcgaaagucgaaauaacccccaacucgccccgggccgaagcaacucuaggaggauucggaucgcuagggcuugacugcgaaccccgaacaggacuagacuucuccgaccuguacuaccuaacaaugaacaacaaacacuggcuaguacacaaagaaugguuccacgacauccccuuacccuggcacgcaggcgccgacacaggaaccccacacuggaacaacaaagaagccuuaguggaguucaaagacgcacacgcaaaacgccaaaccguaguaguacuaggaagccaagaaggagcaguacacacagccuuggccggagcguuagaagccgaaauggacggggcaaaaggcaggcuuagcucgggacacuuaaaaugcagacuaaaaauggacaagcuccgccugaaaggaguauccuacucccuaugcacagccgcguucacauucacgaaaauacccgccgaaacuuuacacggcacggucacagucgagguccaauacgcaggcaccgacgggccaugcaaaguacccgcccaaauggccgucgauaugcaaacccuaaccccaguaggaaggcuuauuaccgccaacccagucauaacagaaagcacagaaaacucaaaaaugaugcuagaacuagauccacccuucggagacuccuacaucgucauaggcguuggagaaaagaaaaucacacaccacuggcacagaucaggaagcaccauaggcaaagccuuugaagcgacaguacgcggcgcaaagagaauggccguacuuggcgacacagccugggacuucggcucagucgggggcgcgcugaacagccuaggcaaagggauacaccaaauauucggagcagcauucaaaucccucuucggcggaaugucaugguucucacaaauccucaucggaacccuacugauguggcuaggccuaaacaccaaaaacggcagcaucucacucaugugccuggcccuaggcggaguccucaucuuccucuccaccgccguaucggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4966 - RNA, 2284 nt, Artificial Sequence
  ZIKV (isolate Z1106033) Polyprotein(108-794)(N444Q) mRNA Design 1 opt
gggagaaagcuuaccaugaccagcguaggaaucgucgggcuacuacucacaacagcaauggcggccgaggucacccgcagaggauccgccuacuacauguaccuagaccgaaacgacgcaggcgaagcgaucagcuucccaacuacacuaggaaugaacaaaugcuacauacaaauaauggaccuuggacacacaugcgacgccaccaugagcuacgaaugcccaaugcuggacgagggaguugagcccgacgauguggacugcuggugcaacaccacgagcacguggguugucuauggcacaugccaccacaagaaaggcgaagccagacgcagccgacgcgcaguaacacucccaucacacucaacaagaaaacuucaaacaagaagccaaaccuggcuggaaagccgagaauacacaaaacaccugauacgagucgaaaacuggaucuuccggaaccccggauucgcacucgcggcugcagccaucgccuggcuacucggcuccagcacaucccaaaaagucaucuaccucgugaugauauuauugauugcacccgcauacucaaucagaugcaucggcguaagcaaucgugauuucguggaggggaugucaggcggcaccuggguggacgucguacuagaacacgggggaugcgucacaguuauggcccaagacaaaccaacagucgacaucgaacugguaaccacaaccguaagcaauauggccgaggugcgaucauacuguuacgaggccagcauaagcgacauggcuucagacucccgcugccccacccaaggagaagcguaccuagacaaacaaucagacacacaauacguaugcaaaaggacccuagucgaccgaggauggggcaacggaugcgggcuauucggcaagggcagccuaguaacuugcgccaaauucgcaugcuccaagaaaaugacaggcaaaagcauacaaccagaaaaccuagaauacagaaucaugcuaucgguacacggaagccaacacagcgggaugauaguacaagacacgggacacgaaacagacgaaaacagggccaaaguagagauaacgcccaacaguccccgggcagaagcaacacuaggcggcuucggaucacuaggccuagacugcgaaccacgcacaggccuagacuucagcgaccucuacuaccucaccaugaacaacaaacacuggcugguacauaaagaaugguuccacgacauaccguuaccguggcacgcaggcgcagacaccggcacaccccacuggaacaacaaagaggcccucguagaguuuaaagacgcccacgcaaaacggcaaacagucguaguccuaggaucgcaagagggcgcaguccacacagcacuagcaggcgcccuagaagccgaaauggacggagccaaaggacgacucuccuccggccaccuaaaaugcagacucaagauggauaaacuccgacuaaaaggcgucuccuacucgcucugcacagcggcauuuacauucaccaaaauaccagccgaaaccuuacacggaaccguuaccgucgaaguacaguacgcaggaacagacgggccaugcaaagucccggcacagauggccgucgacaugcaaacccucaccccagucggccgacucaucacggccaaccccgugaucacagaaucgaccgaaaauucaaaaaugaugcuagaacuugacccacccuucggagacagcuacaucgucauaggcgucggcgagaagaaaaucacccaucacuggcaccgcagcggaagcaccauaggaaaggccuucgaggcaaccgugagaggagcgaaacgaauggccguacucggcgacacugcaugggacuucggcuccgucggcggagcucuaaacucccugggaaaaggaauccaccaaauauucggagccgccuucaaaagccuauucggaggaauguccugguucucacaaauacuaauaggcacccuccugauguggcuaggacuaaacgcaaagaacggguccauaagccugaugugccuggcgcucgggggcguccuaaucuuccuauccacagcaguauccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4967 - RNA, 2284 nt, Artificial Sequence
  ZIKV (strain NatalRGN) Polyprotein(108-794)(N444Q) mRNA Design 1 opt
gggagaaagcuuaccaugacaagcguaggaaucgucgggcuccugcuaacgacagcaauggcagcagaagucacucgacgaggcuccgcauacuacauguaccuggaccgaaacgacgccggagaagccauauccuucccaaccacacuuggcaugaacaaaugcuauauccaaauaauggaccucggacacaugugcgaugccacaaugucauacgaaugcccaaugcucgacgaaggcguggaaccagaugacgucgacugcuggugcaacaccacaagcaccugggucguauacgguacaugccaccacaagaaaggcgaagcacggaggagccgacgagcaguaacccuaccaagccacuccacucgcaaacuccaaacccgaagccaaaccuggcuagaaagccgagaauacaccaaacaccuaauacggguagaaaacuggaucuuccgaaaucccggcuucgcacuagccgccgcggcaaucgcauggcucuuaggcucaaguacaagccaaaaaguaaucuaccucgucaugauucuacuaaucgcccccgccuacuccauacgcugcaucggaguaagcaacagagacuucgucgaagggaugucaggcgguaccuggguggacgucguacuagaacacggcggcugcguaaccgucauggcccaagacaaaccaacgguagacaucgaacucgucaccaccacagucagcaacauggccgaagugcgcuccuauugcuaugaagcaucaauaucagacauggcuucagacucacgaugcccaacacaaggagaagccuaccuagacaaacagucagacacccaauacguaugcaaacgaaccuuagucgaucgcggauggggaaacggcugcggccucuucgggaaaggcucgcuagugacaugcgccaaauucgcaugcuccaagaaaaugaccggcaaaucaauccaaccagagaaccuagaguauaggauaaugcucucaguccacggaucgcaacauagcggaaugauaguccaagacacgggacacgagacggacgagaaccgcgcaaaagucgaaauaacaccaaacagcccccgagcggaagcgacacuaggcggguucggaagccuaggacuagacugcgagccacgaacgggccuggacuucucagaccuauacuaccucaccaugaacaacaaacauuggcuaguccacaaagaaugguuccacgacaucccccucccauggcacgcgggugcagacacaggcacuccccacuggaacaacaaagaggcccuggucgaauuuaaagacgcucacgcgaaaaggcaaaccgucguaguacugggcucacaagaaggcgcgguccauacagcccucgcaggcgcauuagaagccgaaauggacggagcaaaaggacgccuauccucaggccaccucaaaugccgacucaaaauggacaaacuacggcugaaaggaguauccuacagccucugcacagccgcauucaccuucaccaaaauccccgccgaaacccuacacgggaccguaacaguagaaguacaauacgcagggacagauggcccaugcaaagucccggcccagauggccgucgacaugcaaacacuaacaccgguuggacgccucaucacagccaaccccgucauuacagaaucaacagagaacuccaaaaugaugcucgaacuagacccacccuucggagauucauacaucgucauaggcgucggagaaaagaaaauaacucaccacuggcaccgcagcggcagcaccaucggcaaagcauucgaagccacaguccgaggagcaaaaaggauggcaguacucggagacaccgcaugggacuuugguagcgucggcggcgcccuaaacucacuaggaaaaggaauacaucaaaucuucggagcagcauuuaaaagccucuucgguggaaugagcugguucucccaaauacuaaucggaacccuccugauguggcuaggacugaacaccaaaaacggaagcaucagccugaugugccucgcgcucgggggcguacuaaucuucuuaagcacagcaguaucggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4968 - RNA, 2284 nt, Artificial Sequence
  ZIKV (strain ZikaSPH2015) Polyprotein(108-694)-Cterm-JAEV1-E(400-500) mRNA Design 1 opt
gggagaaagcuuaccaugacaagcguuggaaucgucgggcugcuacucacgaccgccauggccgcugaagucacgcgcaggggcucagcauacuacauguaccucgacagaaacgacgcgggcgaagcaaucagcuucccaacaacacucggcaugaacaaaugcuacauacaaauaauggaccucggacacaugugcgacgcaacaaugucguacgaaugccccaugcucgacgaaggaguugaacccgacgacguagacugcuggugcaacacaacaaguaccugggucguguacggaaccugccaccacaagaaaggagaagcuaggcggucacgacgcgcaguaacccugccaagccacuccacgagaaaacuacaaacccgcagccaaacauggcuggaaucacgcgaauacaccaaacaccucauccgcguggaaaacuggauuuucagaaacccaggcuucgcgcuagccgccgccgccauagcauggcuacucgggucauccacaagccaaaaagucauauaccucgucaugauccuguuaaucgccccagcguacagcauacggugcaucggcgucagcaaucgagacuucguggaaggcauguccggcggaaccugggucgacaucguccucgagcacggagggugcguaaccgucauggcacaagacaaaccaacaguagacauagaacucgugacaacaacaguaucuaauauggccgaaguccgcuccuacugcuacgaagccagcaucucagacauggccuccgacucacgcugcccaacgcaaggggaagcauaccucgacaaacaauccgacacccaauacguaugcaaaagaacacucguagaccgaggguggggaaacggaugcggccuauucggaaaaggcagccucguaaccugcgccaaauucgcgugcuccaagaaaaugacgggcaaaagcauccaacccgaaaaccucgaauacagaaucaugcuguccguccacggcucccaacacuccgggaugaucguaaacgacacgggacacgaaaccgacgaaaaccgagccaaaguagaaaucaccccaaacagucccagagccgaagccaccuugggugguuucggaagccucggccucgacugcgaaccgagaacaggccuggacuucagcgaccucuacuaccucacaaugaacaacaaacacugguuaguccauaaagaaugguuccacgacauaccucuccccuggcacgccggcgcagacaccggaaccccacacuggaacaacaaagaggcacuuguagaguucaaagacgcccacgccaaacgacaaaccgucguaguccucggaucacaagaaggcgcgguacacaccgcacucgcgggggcccuggaagcagaaauggacggcgccaagggcagacucagcuccgggcaccucaaaugcagacugaaaauggacaagcuccgacucaagggagucucuuacucacuaugcaccgccgcguucacauucacuaaaaucccagccgaaacacuccacgguaccgucaccguagaaguccaguaugcaggcacugacggcccgugcaaagugcccgcccaaauggccguagacaugcaaacacucaccccaguaggaaggcuaaucacugcaaaccccgugauaacagaaucaaccgaaaacucaaaaaugaugcuagaacuagacccacccuucggagacuccuacaucgucauaggagugggggaaaagaaaaucacacaccacuggcacagguccggcuccacacucggcaaagccuucuccaccacccuaaaaggcgcacaacgccuagcagcccuaggagacacggcgugggacuucggguccauaggcggcguauucaacuccaucggacgcgcaguccaccaagucuucggcggagccuuccgaacccuauucggcggaaugagcuggauaacccagggacugaugggagcacuacugcuauggaugggcgucaacgcacgcgacagaagcauagcacuagccuuccucgccacuggcggaguacucguauuccuggcaacaaacguccacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4969 - RNA, 2284 nt, Artificial Sequence
  ZIKV (isolate Z1106033) Polyprotein(108-694)-Cterm-JAEV1-E(400-500) mRNA Design 1 opt
gggagaaagcuuaccaugaccagcgucggaaucgucggacuccugcuaacaacagcaauggcagccgaagucacgcgaaggggaucggcauacuacauguaucucgaccgcaacgacgcgggcgaagccaucagcuucccaacaacgcugggcaugaacaaaugcuacauacaaauuauggaccuaggacacacaugcgacgcaacaaugagcuacgaaugccccaugcucgacgagggcguugaacccgacgacgucgacugcugguguaauacgacauccacauggguaguauacgggaccugccaccacaagaaaggggaagcgcgccgguccaggagggccgucacucucccgagccacaguaccaggaaacuacaaacccgcagccaaaccuggcucgaaagccgugaauauacaaaacaccuaauucgcguagagaacuggaucuuccgcaaccccggauucgcccuggcagcagcagcaauagccuggcuguugggcucaagcacaagccaaaaggucauauaccugguaaugauccuacuaauagcaccagcauacuccaucagaugcauaggcgugagcaaccgagacuucguugaaggaaugucgggcgggacaugggucgacguaguccuagaacacggaggcugcguaacggucauggcucaagacaagcccacggucgacauagagcuaguuacuacaacaguaagcaacauggccgaagucaggagcuauugcuacgaagccuccaucucagacauggcauccgacucccggugccccacccaaggagaagcauaccucgacaaacaaagcgacacgcaauacgucugcaaaaggacccucgucgaccgcggauggggcaacggaugcgggcuauucggaaaaggaucccucgugaccugcgccaaauucgccugcuccaagaaaaugacaggcaaaagcauacaacccgagaaucuggaauacagaauuaugcucagcguacacggcucacagcacagcggcaugaucguaaacgacaccggacacgaaacggacgaaaaccgagcaaaagucgaaauaacaccaaacagcccucgcgcggaagcgacccugggaggauucgggagccuaggacuggacugcgaaccccgcacgggccuagacuucagcgaucucuauuaccuaaccaugaacaacaaacacuggcuagugcacaaagagugguuccacgacaucccacucccguggcacgccggagccgacacaggaaccccgcacuggaacaacaaagaggcccuuguagaguucaaagacgcacaugcgaaaagacaaacagucguaguccugggcucacaagaaggagccguacacacagcacuagcaggcgcucucgaagccgaaauggacggagccaaagggcgccuaagcuccggccaccugaaaugccgccuaaaaauggacaaacuacgccucaagggaguaucauauucccuaugcaccgcagccuucacauucacaaaaaucccagccgaaacacuacacggcacaguaacagucgaaguacaauacgcaggaacagacggcccaugcaaaguccccgcccaaauggcgguugacaugcaaacccuaaccccagucggacgccugaucacagcaaacccagucaucaccgaauccacagagaacucaaaaaugaugcucgaacuagacccgcccuucggcgauagcuacaucguaauagggguaggagaaaagaaaaucacacaucacuggcaccgcagcggaagcacccuaggcaaagcauucucgaccacacugaaaggagcacaacggcucgcagcccucggagacaccgccugggacuucggauccauagggggagucuucaacucgaucggccgcgcaguacaucaaguauucggcggcgcguucaggacacuauucggaggaaugagcuggaucacacaaggccuaaugggagcccuacuacucuggaugggcgucaacgcacgagaccggagcauagcccuagcauuccucgccaccggaggcguacucguauuccuagcaacgaacguacacgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4970 - RNA, 2272 nt, Artificial Sequence
  ZIKV (strain MR 766) Polyprotein(108-690)-Cterm-JAEV1-E(400-500) mRNA Design 1 opt
gggagaaagcuuaccaugaccagcaucggaauaaucggacuccuccuaacgaccgcaauggcagcagaaauaacacgacgaggcucagccuacuacauguaccuggaccgcagugacgcaggaaaagcgaucucguucgcaacuacccucggcgucaacaaaugccacguccaaaucauggaccucggucacaugugcgacgcaaccauguccuacgaaugcccaauguuagaugaagguguagaaccagacgacguagacugcuggugcaacacgacgucaaccugggucgucuacgguaccugccaucacaagaaaggcgaagcccgccgcagcagacgcgccguaacccuaccaagccacucaacacgaaaacuccagaccagaucacagacguggcuggaaucccgagaauauaccaaacaccuaauaaaagucgaaaacuggauauucagaaaucccggauucgcccucgucgcaguagcaaucgcuuggcuacucggauccagcacaagccaaaaaguaaucuaucucguaaugauacuccuaauagcacccgcauacuccauaagaugcaucggcguaagcaaccgagacuucgucgaaggaaugucgggcggcacauggguagacgugguacuagagcacggaggauguguaacggucauggcacaagauaaaccgaccgucgacauagaacucguaacaaccaccguauccaacauggccgaagucagaagcuacuguuacgaagccuccaucucagacauggccucagacucccgcugccccacacagggcgaagcauaccuagacaagcaauccgacacacaauaugucugcaaacgaacgcuagucgaccgaggaugggggaacggaugcggacucuuugguaagggcucacucguaaccugcgccaaauuuaccugcagcaagaaaaugaccggaaaaagcauccaaccggaaaaccuagaauacagaauuaugcucucgguccacggcucacaacacagcgggaugauaggcuaugaaaccgacgaagacagagccaaaguagaggucacaccaaacagccccagggcagaagcaacccucggcggcuucggaucccucggccucgacugugaaccccgaaccggccuggacuucuccgaccucuacuaccugaccaugaacaacaagcacugguuaguucacaaagaaugguuccaugacaucccccuacccuggcacgccggcgcagacaccggcaccccacacuggaacaacaaagaagcccuagucgaguucaaagacgcacacgccaaacggcaaacagucguaguccuuggcucccaagaaggagccguacacaccgcacucgccggagcacuagaagcagaaauggacggugccaagggccgacucuucagcggacaccuaaaaugccgccucaagauggacaagcuaagacucaaaggggucuccuacucucucugcacugcagccuucaccuucacgaaaguccccgcagaaacccuccacgggacugucaccguagaaguacaauacgccgguaccgacggcccaugcaaaaucccaguacaaauggcaguagacaugcagacacuuacacccguaggacgccuaauaacagcaaaccccgucauaaccgaaagcacagaaaacuccaaaaugaugcuagaacuagacccucccuucggagacagcuacauagugaucggcgucggcgacaagaaaaucacacaccacuggcacagaagcggcagcacccuaggcaaagcauucucuacaacccucaaaggcgcccaacgacuagcagcacucggagacacagccugggacuucggaagcaucggaggcgucuucaacagcauaggacgcgccguacaccaagucuucggaggcgcuuuccgcacccucuucggcggaaugagcuggaucacccaagggcugaugggcgcacuacuacucuggaugggaguaaacgcacgggacagaagcaucgcccuggcuuuucucgccaccggcggcguccucgucuuccuagcaacgaacguacaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4971 - RNA, 2284 nt, Artificial Sequence
  ZIKV (strain NatalRGN) Polyprotein(108-694)-Cterm-JAEV1-E(400-500) mRNA Design 1 opt
gggagaaagcuuaccaugaccuccgucggcauaguaggccuacuacucaccaccgccauggccgccgaagucacgcgcagaggaagcgcauacuacauguaccuggaccgaaacgaugccggcgaagcgaucuccuucccaaccacucucgggaugaacaaaugcuauauccaaaucauggaccuaggacacaugugcgaugcaaccauguccuacgagugcccaaugcuagaugaaggagucgaaccagacgacguggacugcuggugcaacaccaccucgacauggguagucuacggcacaugccaccauaagaagggggaagccagacgcuccagacgagcaguaacgcuccccucacacucaacgagaaaacuccaaaccagaagccagacauggcucgaaucacgcgaguacaccaaacaccucauccgcgucgaaaacuggaucuuccgaaauccuggcuucgcccuagcagcagccgccauagccuggcuacucggcagcagcaccagccaaaaaguaaucuaucuaguaaugauccuacuaaucgcacccgccuacagcauacgcuguaucgguguaucaaaccgcgacuuugucgaaggaaugucaggcggcacaugggucgacguaguccuagaacacggcggcugcgucacaguaauggcacaagacaaaccaacggucgacauagagcuaguaacaacaacgguauccaacauggccgaaguccgaucauacugcuacgaagccuccaucucagacauggcaucggacucccgcuguccgacacaaggagaagcguaccuagacaaacaaucggacacccaauacguaugcaaacgaacucuaguagaccgcggcuggggaaacggauguggccucuucgguaagggcucacucgugaccugcgcaaaauucgcaugcagcaagaaaaugaccggcaaauccauccaaccugaaaaccuagaauaccgaauaaugcuaucaguccacgguucacaacacuccggaaugaucguaaacgacaccggccacgaaacagacgaaaaccgagccaaaguagaaauaacccccaacagcccacgagcggaagcaacccuagggggauucggcucacuggggcuggacugugaacccagaacgggccuagacuucagcgaccucuacuaccuaacaaugaacaauaaacacuggcuaguacacaaagaaugguuccacgacaucccccuccccuggcacgcaggcgccgauaccggcacuccccacuggaacaacaaagaagcucuggucgaguucaaagaugcacacgcuaaaagacaaaccguagucguccuaggcucccaggaaggugcgguccacaccgcccucgcaggagcccucgaggcagaaauggacggcgcuaaaggacgccuaagcuccggccaccucaaaugccgccuaaaaauggacaaguuacgccucaaaggagugaguuacagccucugcacagcggccuucaccuucacaaaaaucccagcagaaacacuacacggaaccgucaccgucgagguucaauacgcaggcacggacgggccaugcaaagucccagcccaaauggccgucgacaugcaaacucuaaccccaguaggccgccucauuacagccaacccaguaaucacugaauccaccgagaacagcaaaaugaugcucgaacucgacccaccauucggggacuccuacaucgucaucggcguaggcgagaagaaaauaacacaccacuggcaccgcucggggagcacucucggcaaggccuucucaaccacacucaaaggcgcccaacgacucgccgcccuaggagacaccgcaugggacuucggcucaaucggcggagucuucaacagcauaggccgcgccguacaccaaguauucggcggagcauuccgcacacuguucgggggaauguccuggauaacacaaggccucaugggcgcccuauuacuuuggauggggguaaacgcccgagaccgaagcauagcccuagccuuccuagccaccggagggguacucguauuuuuagccaccaacguccacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4972 - RNA, 2359 nt, Artificial Sequence
  ZIKV (strain ZikaSPH2015) Polyprotein(93-804) mRNA Design 1 opt
gggagaaagcuuaccaugcgcaucauaaacgcccgcaaggaaaagaaaagacgcggggccgacacauccgucggaauaguaggccugcuacuaacaaccgccauggccgccgagguaacaagacgcggcagcgccuauuacauguaccucgaccgcaaugacgcaggagaagcaauaucauuccccaccaccuugggaaugaacaaauguuacauccaaaucauggaccuaggacacaugugcgacgcaacaaugaguuacgagugcccaaugcuggacgaaggaguggaaccagacgacgucgacuguuggugcaacaccaccagcaccuggguaguauacggcacaugccaccacaagaaaggcgaagcacgacgaagccggagagcgguaacccuccccagccacuccacacgcaaacugcaaaccagaucccaaaccuggcuagaaagccgcgaauacacaaaacaucucauacgcguggaaaacuggauauuuagaaacccaggcuucgcccuagccgccgccgcaaucgcauggcuccucggaagcuccaccagccaaaaaguuauuuaccugguaaugauacuguugauagcacccgccuacagcauucgguguaucggcguaagcaacagagacuucgucgaaggaaugucgggaggcaccugggucgacaucguccuagagcacggcggcugcguaaccgucauggcacaagacaaaccaacagucgacaucgagcucgucaccaccaccguaucaaacauggccgaagugcgcagcuacugcuacgaagcaagcauaucagacauggcuucugacagcagaugccccacacaaggagaggccuaccuagacaagcaauccgacacacaguacguaugcaaacgaacccuagucgaccgaggauggggaaacggaugcggauuauucggcaagggaucccuagucacgugcgcaaaauucgccugcagcaagaaaaugaccggaaaauccauacaaccagaaaaccucgaauacaggauaaugcucagcguacacggcucacaacacaguggcaugaucgucaacgacaccggacaugaaaccgacgaaaaccgcgccaaaguggaaaucaccccaaacagcccacgggcagaggcaacacucggcggcuucggcucccuaggacuggacugcgaacccagaaccggacucgacuucuccgaccucuacuaccuaacaaugaacaacaaacauuggcuggugcacaaagaaugguuccacgacauaccgcuucccuggcacgccggcgccgacacgggaacaccccacuggaacaacaaagaagcccucguagaguucaaagacgcacacgcaaaacgacaaacggucgucguccuagggucacaagaaggcgccguccacaccgcacuagccggcgcacucgaagcagaaauggacggcgccaaaggacgacucucaucaggccaccuaaaaugccgccuaaaaauggacaaacuacgccugaaaggcgucagcuacagccuauguaccgccgcauuuacguuuaccaaaauacccgcagaaacacuccacggcacagucacagucgaaguccaauacgccgggaccgacggccccugcaaaguaccggcccagauggcaguggacaugcaaacgcucaccccaguuggaagacugauaaccgcaaaccccgucaucaccgagagcaccgaaaacucaaaaaugaugcuagaacucgacccacccuucggcgacuccuacaucgucaucggcgucggugaaaagaaaauaacacaucauuggcacagauccggaagcaccaucggaaaagcauucgaagccaccguccgaggagcaaaaagaauggcgguccucggcgacaccgcgugggacuucggaagcgugggcggcgcccucaacagccuagggaaagggauacaccaaauuuucggugcagccuucaaaucacuauucggcggaaugagcugguucucccaaauacuaaucgguacacuacucauguggcuaggccuaaacaccaaaaacggcagcauaagccuaaugugucucgcucuaggcggcguacucaucuuccucucuacagcagucagcgccgacguaggcugcagcgucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4973 - RNA, 2356 nt, Artificial Sequence
  ZIKV prME variant mRNA Design 1 opt
gggagaaagcuuaccaugaucaucaaugcucgaaaagagaagaaacgacguggcgcagacacaucggucggcauaguaggacucuuacucacaaccgcaauggcagcggaagucacccgacgcgggagcgccuacuacauguaccucgaccgcaacgaugccggugaggcaaucucauuccccacgacacuaggaaugaacaaaugcuacauccaaaucauggaccucgggcacaugugcgaugcgacuauguccuaugagugcccaaugcuggaugaaggagucgaacccgacgacguagacugcuggugcaacacgaccaguacaugggucguauacggaacgugccaccacaagaaaggcgaagcccgccgcagccgucgagcagugacccuacccagccacucaacacgcaaacuccaaacacguucacaaaccuggcucgaaagccgagaauacacgaaacaccuaauaagagucgaaaacuggaucuuuaggaacccgggcuucgcacuagcagcggccgcgauagccuggcuccuggggagcucgaccucacaaaaagucauauaccugguaaugauccuacugaucgccccggcauacucuauacgcuguauaggcgucucgaaccgcgacuucguagaaggaaugagcggagggacaugggucgacauaguccuagaacacgggggcugcguaacagucauggcccaagacaaaccaaccgucgacaucgaauuagucacaacuacagucucgaacauggccgaaguacggagcuacugcuacgaagccagcaucagcgacauggccucagacagccgaugcccaacacaaggcgaagcauaccucgacaaacaaagcgacacacaguacguaugcaaacgcacccuaguagacagaggauggggaaacgguugcggacucuucgggaaaggaagccuagucacaugcgcaaaauucgccugcagcaagaaaaugacuggcaaaaguauacaaccagaaaaccucgaauaccgaaucaugcucagcgugcacggaucacaacacucugggaugauaguaaacgacaccggacaugaaaccgaugaaaaccgcgccaaaguagagaucacaccaaacagccccagggccgaagccacccucggaggcuucggcagccugggacuagacugcgaaccccgcacaggccucgacuucucagaucuauacuaccucacaaugaacaacaaacacuggcuaguccacaaagaaugguuccacgacaucccucuaccguggcacgccggcgcagacaccggcaccccacacuggaacaacaaagaagcccuaguggaguucaaagacgcacacgcaaagcgccagacaguaguaguacuagggagccaagaaggagcaguccacacagcacucgccggggcccuagaagccgaaauggacggcgcaaagggacgccuguccucgggacaccuaaaaugccgacugaaaauggacaagcuccgacuaaaaggcguaagcuacagucuaugcacagccgcguucacauucaccaaaaucccugcagagacgcugcacgggaccguaacaguagaaguacaauacgccggcacggacgggcccugcaaaguaccagcacaaauggccgucgacaugcagacacucacacccguaggcagacuaaucacagcaaaccccguaaucaccgagucgacagaaaacaguaagaugaugcuggaacucgacccacccuucggagacuccuacauaguaauaggcgugggugaaaagaaaaucacacaccacuggcaccgaagcggaagcacaauaggcaaagccuucgaagcaacaguaagaggggcaaaacgcauggccguccucggcgacacagcgugggacuucggaagcgucggaggcgcacucaacucccucggaaaaggaauccaccaaauauucggagcagccuucaaaucccuauucggcgggaugaguugguucagccaaauacugauaggcacccugcuaauguggcuaggacucaacaccaaaaacgggucaauaucacucaugugccucgcgcuaggaggagucuuaaucuuccuaucaacagcugucagcgccgauguaggaugcuccguugacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4974 - RNA, 2353 nt, Artificial Sequence
  ZIKV prME variant mRNA Design 1 opt
gggagaaagcuuaccaugaucaacgcaaggaaggagaagaaacgccgaggggccgacacgagcgugggcauagucggccuccuacucacaaccgcgauggcggcagagguaacaagaagaggcagcgccuacuacauguaccucgaccgcaacgacgcaggagaagcaauaucauucccaaccacccuaggcaugaacaaauguuacauacaaaucauggaccuaggccacaugugcgacgccacaauguccuacgaaugcccaaugcuagacgagggcguagagcccgacgacgucgacugcuggugcaacaccacuagcaccugggugguauauggcacuugccaucacaagaaaggagaagcccgccgcuccaggagagcaguaacccuccccagccacagcacaagaaaacuccaaacaagaucccaaacuuggcuggaaucgagagaauacaccaaacaucuaauaagagucgagaacuggaucuuccgaaacccaggauucgcacuagccgcagcagcaauagccuggcuucuaggcucaagcacaucccagaaaguaaucuaccuagucaugauacucuugauagcaccagcauacucaauccgcugcauaggaguaagcaaccgcgacuucgucgaaggaaugagcggaggcacaugggucgauaucguacucgagcacggaggcugcguuacggucauggcacaagacaaacccaccguagacaucgaacugguaaccacaacagugagcaacauggcagaaguacgcagcuacuguuacgaagcaucaaucucagacauggcaucagacagccgaugcccaacacaaggcgaagcguaccucgacaaacaaagcgacacacaauacguauguaaacggacccuggucgaccgaggauggggcaacggaugcggacuguucggcaaaggaucgcucguaacaugcgcaaaauucgcaugcagcaagaaaaugaccggaaaaagcauacaacccgagaaccucgaauaccggaucaugcucucgguacacgggucccaacacagcggcaugauaguaaacgacacgggacacgaaacagacgagaacagagcgaaagucgaaauaacaccaaacagcccccgagcagaagcgacccugggcggcuucgggucccugggacuagacugcgaaccaagaacuggacuagacuuuuccgaccuauacuaccuaaccaugaacaacaaacacuggcugguacacaaagaaugguuccaugacaucccgcucccauggcacgccggggccgauaccggcacaccccacuggaacaacaaagaagcccuagucgaauuuaaagacgcccaugccaaaagacaaacagucgucguacugggcagccaagagggcgccguacacaccgcgcucgcaggcgcacuagaagccgaaauggacggagcaaaaggaagacuaagcucaggccaccuaaaaugcagacucaaaauggacaaacugcgccugaaaggagugucguacucccuaugcacagcagccuucaccuucacaaaaaucccagcagagacgcuacacgggacagucaccguagaggugcaauaugcagggacagacggcccaugcaaaguacccgcccaaauggccguagacaugcaaacccuaacaccagucggacgccucauaacagcaaacccaguaauaacagaaucuacggagaacucgaaaaugaugcuggaacuagauccgcccuucggcgacagcuacaucguaauaggagucggugaaaagaaaauaacacaccacuggcacagauccggcagcacgauaggaaaagccuucgaggcaacaguaaggggcgccaaacgaauggcaguacuaggcgacaccgccugggacuucgggucagucggaggggcacuaaacagucucgggaaaggcauacaccaaauuuucggagccgccuucaaaagccuauucggaggaaugucgugguucucacaaauccuuauaggcacgcuacuaauguggcuugggcuaaauaccaaaaacggcagcaucagccugaugugccuagcacucggaggcgugcucauauuccucagcaccgccgucagcgcggacgucggaugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4975 - RNA, 2350 nt, Artificial Sequence
  ZIKV prME variant mRNA Design 1 opt
gggagaaagcuuaccaugaacgcgcgaaaagaaaagaaaaggcgaggggccgacacaagcguuggaaucgucggccuacucuugacaacggcaauggcagcagaaguaacacggcgcggaucagcguacuacauguaccucgacagaaacgacgccggcgaagccaucagcuuccccacgacccucggcaugaacaaaugcuauauacaaaucauggaccucggccacaugugcgacgcaacaaugagcuacgaauguccaaugcucgacgaaggggucgaaccagacgacguagacuguuggugcaacacaacgagcacauggguaguauacggaacaugccaccacaagaaaggcgaagccagacgcagccgaagggcaguaacacuccccagccacucaacacgcaaacuccaaacccgaucacaaacguggcuagaaucccgugaauacaccaaacaccuuauacgcgucgaaaacuggaucuuccgcaauccaggguucgcacucgccgcagcagccaucgcguggcugcuaggauccagcacaucgcaaaaaguaaucuaccuaguaaugauccuccuaauugccccggcguacucaauccgaugcauaggagucucaaaccgggacuucguagaaggcaugagcggaggcacauggguagacauuguccuagaacacggcgggugugucaccgucauggcccaagacaagccaaccguggacaucgaacucgucacaacaaccguaucuaacauggcagagguaagaucauacugcuacgaagccaguauauccgacauggcaagcgauuccagaugcccaacccaaggcgaagccuaccuagauaaacaaucagacacccaauacguaugcaaacgcaccuuagucgaccgaggcuggggcaauggaugcggccucuucgggaaaggaagccuagucacuugugcgaaauucgccugcagcaagaagaugacaggcaaauccauccagcccgaaaaccucgaauaccgaaucaugcuaagcguacacggcagccaacacucuggaaugauagucaacgacacugggcacgaaacagacgaaaaccgcgcgaaaguggaaaucaccccaaacucacccagagccgaagccacacuaggaggcuucgguucacucggacucgacugcgaaccaagaaccggccuugacuucucagaccuauauuaucuaacaaugaacaacaagcacuggcuggugcacaaagaaugguuccacgacauaccucucccguggcacgcaggcgcagacacaggaacaccacacuggaacaacaaagaagcccuagucgaguucaaagacgcacacgccaaacgacagacuguagucgugcuaggaagccaagaaggagccgugcacacugcccucgcaggggcacuagaagcagaaauggacggagccaaaggaagacuaagcagcggacaccugaaaugcagacuaaaaauggacaaacuaaggcucaaaggagucaguuacucacuaugcacagccgcguucacauucacaaaaauacccgcagaaacgcuccacggaacagucacaguugaaguccaauacgcaggcacagacggccccugcaaagugcccgcccaaauggcaguagacaugcaaacacucacgcccguagggagacuaauaacggcaaacccggucauaaccgaaagcaccgaaaacagcaaaaugaugcucgaacucgauccgccguucggcgauagcuacaucgucauaggagucggcgaaaagaaaaucacacaccacuggcacagauccggauccacaaucggaaaagccuucgaagccacagugcgaggagccaaacguauggcgguacucggcgacacggccugggacuucggcagcgucgggggagcacugaacagccuaggaaagggaauccaccaaaucuucggagccgccuuuaaaagucucuucgggggcaugucaugguucagucaaauacucaucggaacacuacucauguggcuaggccuaaacaccaaaaacggauccauaucacuaaugugccuugcccuaggcggaguccuaauauuccucucaacagcagucagcgccgacgucgggugcucggucgacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4976 - RNA, 2347 nt, Artificial Sequence
  ZIKV prME variant mRNA Design 1 opt
gggagaaagcuuaccauggccagaaaagagaaaaagagacgaggagcggacacguccgucggcaucgucggucuccuucugacaaccgccauggccgcggagguaacccgccgcggaagcgccuacuauauguaccucgacagaaacgacgccggagaagcaaucucauuccccacaacccuaggaaugaacaaaugcuacauccaaaucauggaccucggccacaugugcgacgccacaaugagcuacgagugccccaugcuagacgaaggaguagagcccgacgacgucgacugcuggugcaacaccaccucaaccuggguagucuacggaacaugccaccacaagaaaggcgaggcaagacgcucccgccgagccguuacgcuuccgucacacagcaccagaaaacuccaaaccagaucccagaccuggcucgaauccagagaauacacuaaacaccuuauacgagucgagaacuggaucuucaggaacccaggcuucgcguuagcagcagccgcgaucgccuggcuacucggcaguuccaccagccaaaaaguaauuuaccucgugaugauccuacuaaucgcaccggcauauucuauaagaugcauaggcgucagcaacagggacuucguggaaggaaugucaggaggcaccugggucgauaucguacuagaacacggaggcugcgucaccgucauggcccaagacaaaccaacggucgacaucgaauuagucaccacaaccguaagcaacauggcagaagucagaagcuacugcuacgaagcauccaucuccgacauggcaagcgacucacgcugccccacccaaggcgaagcauaccucgauaaacaaagcgacacacaauacguaugcaaaaggacacucguggacagaggaugggggaacggcugcggccuauucggcaaaggaagccucgugaccugcgccaaauucgcaugcuccaagaaaaugaccggaaaaucaauccaaccagaaaaucucgaauacagaaucaugcucuccguccacgggucccaacacagcggcaugauaguuaacgacacaggccaugagaccgacgaaaaccgggcuaaaguagagauaacccccaacucaccccgggccgaagccacgcuagggggcuucggaagccuaggacucgacugugaaccgcguacgggacucgacuucuccgaccuguauuaucucacaaugaacaacaaacacuggcuaguacacaaagagugguuccacgacauaccgcuaccauggcacgccggcgccgacaccggaacaccacacuggaauaacaaagaagcccucguagaguucaaagacgcgcacgcaaaaagacaaaccgugguagucuuaggcucacaggaaggggcaguacacacagcccuggcaggagcacuagaagccgaaauggauggagcaaaagggcgacuaagcagcgggcaccuuaaaugccgacucaaaauggacaaacuacgccucaaaggagucuccuacucgcuauguaccgccgcauuuacauucaccaaaauccccgcagaaacccuccacggaacaguaacaguagaaguccaauaugccggcacagauggcccaugcaaaguaccugcgcaaauggcagucgacaugcaaacacuaacgccugucggccgacuaaucacagccaacccaguaaucacagaaucgaccgaaaacagcaagaugaugcuagaacuagacccacccuucggcgacuccuacauagucauagggguaggagaaaagaaaaucacucaccacuggcacaggagcggcuccaccauaggaaaagcguucgaagcuaccgucagaggcgcaaaacgcauggcgguacugggagacaccgcaugggacuucggaagcgucggaggggcccuaaacucccuaggaaaaggaauccaccaaauauucggagccgccuucaaaagccuauucggaggcaugagcugguuuucccaaauacuaaucggcacccuccucaugugguuaggacuaaacaccaaaaacggcagcauaucacucaugugccucgcgcuaggcggcguccucauauuccucagcacagcagugucggccgacgucggcugcagcguagacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4977 - RNA, 2344 nt, Artificial Sequence
  ZIKV prME variant mRNA Design 1 opt
gggagaaagcuuaccaugagaaaagagaagaaacgaagaggagcagacaccagcguaggaauagucggacuccuccuaacuaccgcaauggcagcagaagucacgcgaagaggcagcgcguacuacauguaccuagaccggaacgaugccggcgaggccaucucauucccaacaacacucgggaugaacaaaugcuacauacagaucauggaccucgggcacaugugcgacgccacuauguccuacgagugcccgaugcuggacgaaggcgucgagccagacgacgucgacuguugguguaacacuaccagcaccuggguaguauacggaacaugccaccacaagaaaggagaagcccgcaggagcagacgcgcggucacgcugccaucccacagcacgcgcaaacuccaaacuaggucacaaaccuggcuagagagccgagaauacaccaagcaccuaaucagagucgaaaacuggauauuccgcaacccaggauuugcacuagcggccgccgcaauagcguggcuacuaggcucgagcacaucccaaaaagugaucuaccuagucaugauacuccuaaucgcacccgcauacagcauccgaugcauaggagucucuaacagagauuucgucgaaggaaugucgggcggaacgugggucgacauaguacuagaacacggaggcugcguaaccgugauggcccaagacaaaccaaccgucgacaucgagcuagucacgacuaccguaagcaacauggcagaaguacgauccuacugcuacgaagcaagcaucucagacauggccagcgacagccgaugccccacccagggcgaagcauaccuagacaaacaaucagacacacaauacgucugcaaaagaacacucguagaucgcggauggggcaacggaugcggacucuucggaaaaggcagucuagucacaugcgccaaauucgcaugcucaaagaaaaugaccgguaaauccauacaaccagaaaaccucgaauaccggauaaugcucucaguacaugggagccaacacagcggcaugauagucaacgacacagggcacgaaacugacgaaaaccgcgccaaaguagaaauaacaccaaacagcccccgcgccgaagccacacugggaggcuuuggaagccucggcuuagauugcgagccacgaacaggccuagacuucucggaccuauacuaccucacgaugaacaacaaacacuggcuaguacauaaagaaugguuccaugacaucccccucccauggcacgcuggcgcggacacggggacaccacacuggaacaacaaggaagcccugguagaguucaaggacgcccacgcgaaaaggcaaacagucgugguauuaggcagccaggaaggcgccguccacaccgcauuagccggcgcccuggaagccgaaauggacggagcaaaaggcagauuaagcuccggacaccucaaaugccggcuaaagauggacaaacucagauugaaaggaguauccuacagccuuugcaccgcagccuucaccuucacgaaaauaccagccgaaacacuacacggaacaguaacggucgaagugcaauacgcaggaacagacggccccugcaaaguaccagcgcaaauggcagucgacaugcaaacccugacgccggucggcagacuaaucaccgcaaacccagucaucacagaauccaccgaaaacucaaaaaugaugcuagaacuggacccacccuucggagacuccuacauuguaauaggagucggcgaaaagaaaauaacccaccacuggcaccgaucaggcagcacaauaggcaaagcauucgaagccaccguaagaggcgcaaaacgcauggcaguacugggagacaccgcaugggacuucggcagcguuggcggagcccucaacuccuuaggcaaaggaauccaccaaauauucggagcagcauucaaaagccuguuuggcgguaugagcugguucucccaaauacucaucgggacacugcugauguggcucggacucaacacgaaaaacgguagcauaagucugaugugccucgcccuaggcggcguacucaucuuccuaaguacagcgguaucagcagacguaggcugcagcgucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4978 - RNA, 2341 nt, Artificial Sequence
  ZIKV prME variant mRNA Design 1 opt
gggagaaagcuuaccaugaaagaaaagaaacgccgaggcgcagacaccaguguaggcauaguaggacuucuccuaacaacagccauggcggcggaaguaacucgcagaggcuccgccuacuacauguaucucgaccgaaacgacgcgggugaagcaaucagcuucccaaccacucucggcaugaacaaaugcuacauccaaaucauggaccucggccacaugugcgacgccacaaugagcuaugaaugccccaugcuagacgaaggcguagaacccgacgacguagacugcugguguaacaccaccucaaccugggucgucuacggaacgugccaccauaagaaaggagaagcacgccgcagcagacgcgcggucacauuaccaagccauagcacgcgcaaacuacaaacccggucacagacauggcucgagagccgagaguacaccaaacaccuaauacgcgucgaaaacuggauauuccgaaaccccggauucgcacuugcagcggccgccaucgcauggcuccugggcucaagcaccagccaaaaaguaaucuaccuagucaugauccugcuaaucgccccagccuacagcaucaggugcauaggcgugagcaaccgagacuucgucgaaggaaugucgggcggaaccuggguagacaucguacuggaacauggcggcugcgucaccguaauggcccaagacaagcccaccgucgacauagaacucgucacaacuaccgucuccaacauggccgagguacgcuccuacugcuacgaagccucaaucuccgacauggccagcgacucacgaugcccuacgcaaggcgaagccuaccuggacaaacaaucggacacacaauacgugugcaaacgaacauuagucgaccgaggaugggggaacggcugcggccuguucggcaaaggcucauuagugaccugcgcaaaguuugccugcagcaaaaagaugaccggaaaauccauacaaccagaaaaccuagaauacagaaucaugcugucaguacauggcucacaacacagugguaugaucgucaacgacacgggccacgaaacagacgaaaaccgagcgaaaguagaaaucaccccaaacagcccgcgcgcugaagccacacucggagguuucggcucacuaggccuagacugcgagccacgaacuggccuugacuucuccgaccuguacuaccucaccaugaauaacaaacacuggcuaguacacaaagaaugguuccacgacaucccacuacccuggcacgccggcgccgacaccgggaccccacacuggaacaacaaagaagcacugguagaguucaaagacgcccacgccaaaagacaaaccgucguaguacuaggcagccaagaaggugcgguccacaccgcccuagccggcgcccuagaagccgaaauggacggugccaaaggccgccuuagcuccggucaccuaaaaugccgacuaaaaauggacaaacugagacuaaaaggcgucucauacucauuaugcacagcagccuuuacuuucacaaagaucccagccgagacgcuacacggaacaguaacaguagaaguacaguacgccgggaccgacggccccugcaaaguccccgcccaaauggccguagacaugcagacacuaaccccagucgggagacugaucaccgccaacccgguaauaacagaaagcaccgaaaacuccaaaaugaugcuugagcuagacccaccuuucggggauagcuacaucgucaucgggguaggcgagaagaaaauaacacaucacuggcauagaagcggcagcacgauaggaaaagcauucgaagcaacaguccgcggcgcaaaacgcauggccguuuugggcgacacagcaugggacuucggcuccgugggcggcgcacucaacuccuuaggcaaaggcauccaccagaucuucggggccgccuucaaaucacuauucggcggcaugucaugguucagccagauccucauaggcacacuccuaauguggcugggacuaaauaccaaaaacggcuccaucucacucaugugccuugcccucggaggcguccuaaucuuccuuaguacagccguaagcgccgacgucggaugcuccguagacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4979 - RNA, 2338 nt, Artificial Sequence
  ZIKV prME variant mRNA Design 1 opt
gggagaaagcuuaccauggaaaagaaaagacgcggcgccgacacgagcgucgguauaguaggacuucuacucacgaccgccauggcggccgaaguaaccagacggggcagcgccuacuacauguaucucgaccgcaacgacgccggcgaagccaucucguuccccaccacacuagggaugaacaaauguuacauccaaauaauggaccucgggcacaugugcgacgcgacaaugaguuacgaaugcccaauguuagacgaaggcguagaaccggacgacgucgauugcugguguaacaccacaucaaccuggguagucuacgggaccugccaccacaaaaagggcgaagcccgaagaucacggagagccguuacccuaccgagccacuccacaagaaaauuacaaacacgaagccagaccugguuagaaucaagagaguacacaaaacaccugauaagaguagagaacuggaucuuccgaaacccgggcuucgcacuagccgccgccgcaaucgccuggcuccuaggauccucaaccagccaaaaagucauuuaccucguaaugauccuccucauagcaccagcauacuccauccgaugcaucgguguuuccaacagagacuucguagaaggcaugucgggcggcaccugggucgacaucguccuagagcacggaggcugcgugacugucauggcacaagacaagcccaccgucgacaucgagcuaguaaccacaacaguauccaacauggcugaaguccgaagcuacugcuacgaagcaucaaucucugacauggccagcgacagccgaugccccacacaaggagaagccuaccuagacaaacaaagcgacacccaauacgucugcaagcgcacccuagucgaccgcggauggggaaacgggugcggacucuucgggaagggaagccuaguaacaugcgccaaauucgcgugcucaaagaaaaugacgggcaagaguauccagcccgaaaacuuagaauacagaaucaugcucucgguucacggaucccaacacagcggcaugauaguaaacgacaccggccacgaaacagacgaaaacagggcaaaaguagaaaucacccccaacucacccagagccgaagccacgcucggcggcuucgggucacucgggcucgacugcgagccccgaaccggacuugacuucagcgaccuuuacuaccuaacaaugaacaacaagcacugguuagugcacaaagagugguuccacgauaucccacuccccuggcacgcaggcgcagacaccgguacaccccacuggaacaacaaagaagcacucguagaguucaaagaugcccacgcaaaaaggcaaaccgucguaguauuaggcagccaagaaggcgcaguacacaccgcccucgccggagcccuagaagcagaaauggacggcgcaaaaggaagacucuccucaggccaccucaaaugccgauugaagauggacaaacuucgacucaagggagucaguuacucauuaugcacugcagccuucaccuucaccaaaaucccggcagaaacgcuacacggaaccguaaccgucgaaguccaauaugcaggcaccgacggcccgugcaaaguacccgcccagauggcggucgacaugcaaacgcugacaccgguaggucgccucauaaccgccaaccccguuauaacggaauccaccgaaaacuccaaaaugaugcucgaacuagacccgcccuucggagacagcuacaucgugaucggugucggagaaaagaaaauaacccaccacuggcacagaagugggagcacaaucggaaaagccuucgaagccaccgucagaggcgccaaacgcauggccguccucggcgacacagcaugggacuucgggagcgucggcggugcccuaaacagccucggcaaaggcauacaccaaauauucggagcagcuuucaagagcuuauucgggggcaugagcugguucucccaaauccuaaucgggacccuacucauguggcucggacuaaacaccaaaaacggaagcauuagccucaugugccuggcccucgggggcguacucaucuuccugucgaccgccguaagcgcugaugucggaugcuccguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4980 - RNA, 2335 nt, Artificial Sequence
  ZIKV prME variant mRNA Design 1 opt
gggagaaagcuuaccaugaagaaacgacggggcgcagacacauccgucggcaucguaggacuccugcuaaccacagcaauggcagccgaagucacacgcaggggcucugcauacuauauguaccuagaccggaacgacgcaggagaagccauaucguucccaaccacacugggaaugaacaaaugcuauauacagauuauggaccucggccacaugugcgacgccaccaugagcuacgaaugcccuaugcucgacgagggcguggaaccagacgacgucgacugcuggugcaacacgacaagcaccuggguggucuacggaaccugccaccacaagaaaggcgaggcgagacgcucccgacgcgcggucacccucccaagccacucaacgcgcaaacuacagacaagaucccaaacauggcucgaaagccgcgaauacaccaaacaccuaauccgagucgaaaacuggaucuuccgcaaccccggauucgcacuagccgccgccgcaauagcauggcucuuaggcucaagcaccagccaaaaaguaaucuaccucguaaugauccuucucaucgcaccagccuauucaauaagaugcauaggaguuagcaacagagacuucguagaaggaaugucgggaggaaccugggucgacaucguccucgagcacgggggcugcgucaccgucauggcucaggacaaaccaacagucgauaucgagcuagucaccacgacaguaagcaacauggcagaaguacgguccuacugcuacgaagcaucgaucuccgacauggcaucagacucacgaugcccaacccaaggcgaagcauaccuagacaagcaaucagacacgcaguacguaugcaagcgaacacugguagacagaggcuggggcaacggaugcggccuauucggaaagggcucacugguaaccugugcaaaauucgcaugcucaaagaaaaugacaggaaaaagcauacaacccgaaaaccucgaguaccguauaaugcucucaguccacggaagccaacauuccggcaugaucguaaacgacacaggacacgagaccgacgaaaacagagccaaagucgaaaucacgcccaauagcccacgcgccgaagccacccuaggaggcuucggaucacuaggauuggacugcgaaccacguaccggccuagacuucucagaccuauacuaccuaaccaugaauaacaaacacugguuagugcacaaagagugguuccacgacauaccacucccauggcacgcgggcgcggacacaggcacaccccacuggaacaacaaagaagcccuaguagaguucaaagacgcacacgcaaaacggcaaaccguaguaguccugggcagccaagaaggcgccguacacaccgcgcuggccggagcccucgaagcagaaauggacggcgcgaaaggaagacuauccuccggccaccuaaaaugccgacucaaaauggacaagcuaaggcugaaaggcgucagcuacucccucuguaccgcagcguuuaccuucaccaaaaucccagcagaaacccuccacggaacagugacaguagaaguccaauacgccggcacagauggcccuugcaagguaccagcgcaaauggcggucgacaugcaaacacuaacaccggucggccgccucauaacagccaaucccguaaucacagaaagcaccgaaaacagcaaaaugaugcucgaacuagacccgccauucggcgacagcuacaucgugauaggagucggcgaaaagaaaauaacacaucauuggcacagaagcggcuccacaaucggcaaagcauucgaagcaacaguaagaggcgccaaacgaauggcaguccugggugacacagcgugggauuucgggucagucggaggugcccuuaacagccuaggaaaagggauccaccaaauauucggggccgcauucaaaucacuuuucgggggaauguccugguucucccaaauccucaucggaacacuccuaauguggcucggacucaacaccaaaaacggcagcaucagccucaugugccucgcacucggaggcguacuaauauuccugucaacggcaguuagcgcagacguagggugcucagucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4981 - RNA, 2332 nt, Artificial Sequence
  ZIKV prME variant mRNA Design 1 opt
gggagaaagcuuaccaugaagaggagaggggcggacaccagcgucggcauagucggccuacuacucacgaccgcaauggccgccgaaguaacacguagaggaucggccuacuacauguaccucgacaggaacgacgccggagaagccaucucauuccccacaacacugggaaugaacaaauguuacauccaaaucauggacuuaggacacaugugcgacgccaccaugucauacgaaugccccaugcucgacgaaggcguggaacccgacgacgucgacugcugguguaacacaacaucaaccuggguagucuacggcacaugccaccacaagaaaggcgaagcccgucgcagcagaagggcaguaacccucccaagccacucaacgcggaaacugcaaacccgaagucaaaccuggcuggaaucgagggaauacacaaaacaccuaauccgaguagaaaacuggaucuuccgcaauccaggcuucgcacucgccgcagcagccauagccuggcuacucggcagcuccacaagccaaaaaguaauuuaccucgucaugauacuacugaucgcccccgccuacuccaucagaugcaucggcgucucaaaccgcgauuucgucgaaggcaugucagguggcaccuggguagacaucguccucgaacacggaggcugcgucaccgucauggcacaagacaaacccacagucgacaucgaauuggucacaaccaccgucagcaacauggccgaaguacgaagcuacugcuacgaagcgucaauauccgacauggcgagcgacucccgauguccaacucaaggagaagcguaucucgacaagcaaucggacacccaauacguauguaaacgaacccuaguagaccgcggauggggcaacggaugcggccuauucggaaaaggcucccucgugacaugugcaaaguuugccugcagcaagaaaaugacaggcaaaagcauccaaccagaaaaccuagaauaccgaaucauguugucaguacacggcucccaacacaguggaaugauagugaacgacacaggccacgaaacagacgagaaucgcgccaaagucgagauaaccccuaacucaccacgcgcagaagcgacacugggaggauucgggucccuaggccucgacugcgaaccacgcaccggcuuagacuucagcgaucucuacuaccuaaccaugaacaacaaacacuggcucguacacaaagaaugguuccacgauaucccacuccccuggcacgccggcgcugacacaggcacgccccacuggaacaacaaagaagcgcuuguggaguucaaggacgcccacgcaaaaaggcaaaccgucguaguacuaggcucacaagagggcgccguacacaccgcccuggcaggcgcacucgaagccgaaauggacggcgccaaaggacggcucuccagcggacaccucaagugccgccuaaaaauggacaaacugagacuaaaaggcguaucauacagccugugcaccgccgcauucaccuucaccaaaauacccgcggaaacccuacacggcacaguaaccguagaaguacaauacgcaggcaccgacggccccugcaaaguaccggcccagauggccguagacaugcaaacccucacucccgucggacgccucaucacagcaaaccccgucauaacagaauccaccgaaaacagcaaaaugaugcucgaacucgacccacccuucggagacuccuacauaguaaucggagucggcgagaagaaaaucacccaccacuggcaucgaucaggaucaacgaucggcaaagcauucgaagcaaccgugcggggagcaaaaaggauggccguacucggcgacaccgccugggacuucgggucagucgggggcgcccuaaacucccugggaaaaggcauucaccaaaucuucggugccgccuucaaaagccuguucgggggcaugagcugguucagccaaauacucauaggcacacuccugauguggcuaggccucaacaccaagaacggcagcaucaguuuaaugugccuagcccugggaggaguccucaucuuccucagcacagccguaucagcagacguaggcuguagcgucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4982 - RNA, 2329 nt, Artificial Sequence
  ZIKV prME variant mRNA Design 1 opt
gggagaaagcuuaccaugcgccggggcgcagacacaucagugggcaucguaggccuccugcucaccaccgcgauggccgcagaggucacccgacgcgggagcgccuacuacauguaccuagaccgaaacgaugccggcgaagccaucucguucccgacaacccugggcaugaauaaaugcuacauccaaauaauggaccuaggucacaugugcgacgcaacuaugucuuacgaaugcccgaugcucgacgaggguguggaaccugaugacguagacugcuggugcaacaccacaagcacaugggugguauacggaacaugccaccacaagaaaggcgaagcacgacggagccggcgcgcagucacccuaccgagccacucaacccgaaaacuccaaacccgcagccaaacaugguuggaaagccgcgaauacacaaaacaccuaauccgcgucgaaaacuggaucuuccgcaacccgggcuucgcccucgcagccgcagccaucgccuggcuuuuaggcucauccaccucacaaaaaguaaucuaccuagucaugauccuacucauagccccugcauacuccaucaggugcauaggcguauccaacagggacuucgucgaaggcaugagcggcggcaccugggucgacaucguacucgaacacgggggcugcguaacagucauggcacaagacaaacccacagucgacaucgaacucgugacaaccacagucagcaacauggcagaaguaagaucauacugcuacgaagcauccauaagcgacauggcaucugacagcagaugcccaacacagggagaagcauaccucgacaaacaaagcgacacacaauacgucuguaaacgaacccuaguagaccgcggauggggaaacggcugcggacucuucggaaaaggcagccucguaacaugcgccaaauucgccugcagcaagaaaaugaccggcaaauccauacaacccgaaaaccucgaguacagaaucaugcuuucaguccacggaagccaacauuccggcaugauagucaacgacaccggacacgaaaccgacgaaaacagagcgaaagucgaaaucacacccaacucacccagggcggaagcaacacugggaggauucgggucacucggucuugauugugaaccccgaacuggacucgacuucuccgaccucuacuaccucaccaugaacaacaaacacuggcuaguccacaaagagugguuccacgacaucccacuacccuggcacgcaggagccgacacaggcaccccacacuggaacaacaaagaagcacuggucgaguucaaagacgcacacgccaaacgccaaacugucgucguacuaggcagccaggaaggagcaguccacacagcacuggccggagcucuagaagcagagauggacggcgcgaaaggacgccuaagcucaggccacuuaaaaugccgacucaaaauggacaaacuccgucuuaaaggagucucguacucacugugcaccgcugcauucaccuuuaccaagauccccgcggaaacccuacacggaaccgucacaguagaaguccaauacgccggaacugacggcccaugcaaaguccccgcccaaauggcaguggauaugcaaacccuaacccccguaggacgccuaauaacagccaaccccguuaucaccgaauccaccgaaaacucuaaaaugaugcuggaacuagauccacccuucggagacuccuauauaguaaucggcgucggagaaaagaaaaucacgcaccacuggcaccggagcggcucaaccaucggaaaagccuuugaggcgaccguccgcggagccaaacgcauggcaguacucggagacacagccugggacuucgggagcgucggaggcgcccuaaacucacucggcaaaggcauccaccaaaucuucggagccgcauucaaaucccucuucggcggcaugagcugguucucacagauacuaauaggaacccuccuaauguggcucggccucaacaccaaaaacgguagcaucagccuaaugugccuagcacuaggcggcguacuaauauuccucuccaccgccgucagcgccgacgugggcuguuccgucgacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4983 - RNA, 2326 nt, Artificial Sequence
  ZIKV prME variant mRNA Design 1 opt
gggagaaagcuuaccaugagaggcgccgauacuagcguaggaaucgugggacuccuacucacaacugcaauggccgcagaagucacaagacgaggaagcgcauacuacauguaucuagaccggaacgacgccggagaagcaaucagcuucccgacaacacuaggaaugaauaaaugcuauauccaaauaauggaccuaggccacaugugcgacgcgaccaugagcuacgagugccccaugcucgaugaaggcgucgaaccagacgacgucgacugcuggugcaacacuacaagcacauggguaguauacgggacaugucaccacaagaaaggagaagccagacgcucgcgccgcgcagucacacuccccucacacucaacacggaaacuacaaacgcgcucgcaaaccugguuggaaucccgagaauacaccaaacaccuaauccgcgucgaaaacuggaucuuccgcaacccggguuucgcacucgcagccgcagccaucgccuggcuacucggcagcucaacaagccaaaaagucauauaccuaguaaugauacuacugaucgcaccagccuacagcaucagaugcaucggcgucucaaaccgcgacuucgucgaaggaauguccggcggaaccuggguagacaucguacuagaacacggcggaugcgucaccgucauggcacaagacaaacccacaguagacauugagcucguaacaacaacagucuccaacauggccgagguccgaucauacugcuacgaagcauccaucagcgacauggccagcgacuccaggugcccgacccaaggcgaagccuaucucgacaaacagagcgacacgcaguacgucugcaaacgaacauuagucgaccgaggcuggggaaacggaugcggccuauucggaaaaggaagccuagucacgugcgcaaaauucgcaugcucaaagaaaaugaccggaaaaucgauccaacccgaaaaccuggaauaccgaauaaugcucuccguacacgggagccagcacucaggaaugauagucaaugacaccggccacgaaacagacgagaaucgagcuaaaguagagauaacacccaacagccccagagcagaagcgacccucggcggcuucggcucccucggcuuagacugcgaaccacgcaccggccucgacuucagcgaccuauacuauuuaacaaugaacaacaaacacuggcuagugcacaaagaaugguuccacgacauaccacuaccauggcacgcaggggcagacacggggaccccacacuggaacaacaaagaagcccuaguagaguucaaagacgcacacgcaaaacgacaaacaguagucguacuugggagccaggaaggcgcaguccacaccgcacuagccggggcccucgaagcagaaauggacggggcaaaaggcagacuaagcagcggacaucugaaaugcagacucaaaauggacaaacuccgccuaaaaggcguguccuacucacuaugcaccgcagccuucaccuucacgaaaaucccagcggaaaccuuacacggcaccgucacaguggaaguacaauacgccggcaccgacggaccaugcaaaguaccagcacagauggccgucgauaugcaaacacugacgcccgucggacgacugaucacugcaaacccgguaaucaccgaaagcacagaaaacucaaaaaugaugcucgagcucgacccucccuucggagacagcuacaucgucaucggagucggagaaaagaaaauaacucaucacuggcaccgcagcggaucaaccaucggcaaagccuucgaagcuacagucagaggcgcaaagagaauggcgguacuaggcgacacagcaugggacuucggaucagugggaggcgcacugaacagccucggaaaggggauacaccaaaucuucggcgccgcauucaaaagccucuucggcggcaugagcugguuuucccagauacuaaucggaacgcuccuaauguggcuagggcuaaacaccaaaaacggcagcauaagccugaugugccucgcgcucggaggcguccucaucuuccuaucaaccgcagucucggcagauguaggcugcucagucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4984 - RNA, 2323 nt, Artificial Sequence
  ZIKV prME variant mRNA Design 1 opt
gggagaaagcuuaccaugggggccgacacuuccguaggcaucgucggacuacuccugaccacggccauggccgccgaaguaacccgccgcggcagcgcauacuacauguaccucgaccgcaacgacgccggggaagcuauaucguucccaacaacccucggaaugaacaaaugcuacauacaaaucauggaccucggccacaugugcgacgcaaccaugagcuacgaauguccaaugcuggacgaagggguagaaccagacgacguggacugcuggugcaacaccacaagcaccugggucgucuacggaaccugccaccacaagaaaggagaggcccgacgaagucgccgcgcagucacccucccaagccacucuacacgaaaacuucaaacccggucacaaacauggcucgaaucaagagaauacaccaaacaccucauccgagucgaaaacuggaucuucagaaaccccggauucgcccucgcagcggccgccauagcguggcuacuaggcucaagcaccucacaaaaagucaucuaccuggucaugauccuccuaauagcacccgccuacagcauccgcugcaucggcgucucaaacagagacuucguagaaggaaugagcggaggaacauggguagacauagugcucgaacauggaggcugcguaaccgucauggcccaagacaaaccaaccgucgacauagaacuggucacuacaaccguaucuaacauggccgagguaagaucauacugcuacgaagccuccaucuccgacauggccagugacagccgaugcccaacgcaaggcgaagccuaucucgacaaacaauccgacacccaauaugucugcaagcgcacacucguagaccgcggcuggggaaacggcugcggccucuucggcaaaggcagccuaguaaccugcgcaaaauucgcaugcuccaagaaaaugacaggaaaauccauccaacccgaaaaccucgaauaccgcaucaugcucuccgugcacggcagccaacacuccggaaugaucguaaacgacaccggacacgaaacagacgaaaaccgcgccaaagucgaaauaacaccaaacuccccacgcgcggaagccacacuaggcggcuucggcucccuaggccucgacugcgaacccagaacaggacucgacuucagcgaccucuauuaccuaaccaugaacaacaaacauugguuaguacacaaggaaugguuucacgacaucccccuccccuggcacgcaggcgcagauacaggaacaccacacuggaacaacaaagaagcccucguagaauuuaaagacgcccacgcuaaacggcaaacaguaguaguccuaggcagccaagagggggccguacacaccgcacucgcaggcgcccucgaagcugaaauggauggcgccaaaggcaggcucucaucgggucaccucaaaugccgacuaaaaauggacaaacuacgucuaaaaggggucucuuacucacucuguacggcggccuucaccuucaccaaaauaccagcagagacacuacacggaaccgucacagucgagguccaauacgccggcacagacggaccaugcaaagucccugcacaaauggccgucgacaugcaaacccucacaccaguaggacgccucaucacggccaaccccgucaucacagaaagcaccgaaaacuccaaaaugaugcucgaacuagaucccccguucggagacagcuacaucguaauaggcgucggagagaagaaaauaacacaccacuggcaccgauccggauccacaauaggcaaagccuucgaagcaaccgucagaggcgcaaaacgaauggccguacugggagacacagccugggacuucggaagcgugggcggagcacucaacagccuuggcaaaggaauccaccaaaucuucggcgcagcauucaaaucacucuucggaggcauguccugguucucacaaauacugauagggacacuccugaugugguuaggucucaacaccaaaaacggcagcauuucucucaugugccucgcccucggaggaguacucaucuuccucuccacagcggucagcgcagacgucggaugcuccgucgacuuuucgaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4985 - RNA, 2320 nt, Artificial Sequence
  ZIKV prME variant mRNA Design 1 opt
gggagaaagcuuaccauggccgacaccagcgucggaaucgucgggcuccuauugaccaccgccauggccgccgaagucacccgccgcggaagcgccuacuacauguaccuagaccgaaacgacgcaggcgaagccaucagcuuccccacaacacuaggcaugaacaaaugcuacauucaaaucauggaccuaggccacaugugcgacgcaaccaugucauacgagugucccaugcuagacgaaggaguagaaccagacgauguagacugcuggugcaacaccaccuccacaugggucgucuacggaaccugccaccacaaaaagggcgaggcacgacgaucacgccgcgccgucacucuaccaucacacucaacucgaaaacuacaaacccgcucccaaacaugguuagaaagccgcgaguauacgaaacaccuaauccgaguagaaaauuggauauuccggaacccaggcuucgcacuggcagccgccgcaaucgcauggcuucugggauccucaacgucacaaaaagucaucuaccucgucaugauacugcucauagcaccagcauauuccauccgcuguaucgggguauccaacagggacuucguugaaggcaugucaggagggacaugggucgacaucguccucgaacacggaggcugcgucacagucauggcacaagacaaacccaccguagacaucgagcucgucaccacaacagucagcaacauggccgaaguccgcagcuacugcuacgaagcaucaaucagcgauauggccagcgacucaaggugcccuacucaaggcgaggcuuaccuagauaaacaaagcgacacccaauacgucugcaaacgcacccuaguagaccgaggauggggaaacggaugcggccucuucggcaaaggcucccucgugacaugcgcaaaauucgcaugcagcaagaaaaugacaggcaaaagcauacaaccagaaaaccucgaauacagaaucaugcugagcguccacgggucacaacacucaggcaugauagugaacgacaccggccacgaaaccgacgaaaaccgcgcaaaaguagaaauaaccccaaacagcccacgagccgaagccacccuaggcggcuuuggaagccucggccuagacugcgagccccgcaccggucuagacuucagcgaccucuacuaccugaccaugaacaacaaacauuggcucgugcacaaagagugguuccacgacauaccccuaccuuggcacgcaggagcagacaccggcacaccccacuggaacaacaaggaggcacugguagaguucaaggacgcccacgcaaaacgacaaacaguagucgugcuaggaucucaagaaggcgccguccacacagccuuagccggggcacucgaagcagagauggacggagccaaaggacgacuauccuccggccaucucaaaugccgccucaaaauggacaagcuccgacuaaaaggcguaagcuacagccuuugcacggcagcauucacguucacgaaaauucccgccgaaacacuccacggcacaguaaccgucgaaguacaauacgccggcacagaugggcccugcaagguccccgcccaaauggcaguugacaugcaaacccucacccccguaggccggcugaucaccgccaacccagucaucaccgaauccaccgagaacagcaaaaugaugcucgaacucgaucccccuuucggagacuccuacauagucaucggaguaggagaaaagaaaaucacccaccacuggcaccgcagcggcuccaccauaggaaaagcauucgaagcuaccguccgcggggccaaacgcauggccguacucggcgacacggcgugggacuucggcucgguuggaggagcccuaaauagccucggcaaaggaauccaccaaauauucggagcggcuuucaaaucccuuuucgguggcaugucaugguuuagccaaauucucaucggaacacugcucauguggcugggcuuaaacaccaaaaauggaucaaucucgcucaugugccuagcacuaggagggguccuaauauuccugucaaccgcagugagcgccgacguaggcugcagcgucgacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4986 - RNA, 2317 nt, Artificial Sequence
  ZIKV prME variant mRNA Design 1 opt
gggagaaagcuuaccauggacacaucaguuggcaucgucgggcugcuacucaccacggccauggccgcagaagugacaagaagaggaagcgcauacuacauguaucuggaucgcaacgacgccggcgaagcgaucagcuucccaacgacccucggaaugaacaaaugcuacauacagaucauggaccuaggacacaugugcgacgcgaccauguccuacgagugcccaaugcuagacgaaggcgucgagccagacgacgucgacugcugguguaauacgaccucaaccuggguagucuacgguacaugccaccacaagaaaggcgaagcacgaagaucaagacgagccgucacccuacccucacacagcacuagaaaacuccaaacccgaagucaaacauggcuagaaagucgagaauacacgaaacaccugauccgcguagaaaacuggauauuccgaaacccaggcuucgcgcucgccgcagccgccauagccuggcuccucggcagcagcaccagucagaaggucauauaucucgugaugauccuccucaucgccccugccuacucaauaagaugcaucggcguaagcaaccgggacuucguggaaggaaugucuggaggcaccuggguagacauaguccucgaacacggaggcugcguaacuguaauggcccaagacaaaccuacagucgacauugaacuggucaccaccaccguauccaacauggccgaagugcgcagcuacugcuacgaagccagcaucucagacauggcgagugacagccgaugccccacucaaggcgaagccuaccuagacaaacaaagcgacacacaauacgucugcaaacgaacacucgucgaucguggaugggguaacggaugcggccucuucggcaaagguucccuagucacuugcgcaaaauucgccugcagcaaaaagaugacaggaaagagcauacaacccgaaaaccuagaauaccgcaucaugcugagcguccacggcagccagcacagcggaaugauaguaaacgacacaggacacgaaaccgacgaaaauagggcgaaagucgaaaucacccccaacagccccagagcggaagcaacacuagguggcuucgggagccucggauuagacugcgagccccgaacaggccucgacuucagcgaccuauacuaccuaacaaugaacaacaaacacugguuaguccacaaagagugguuccaugacaucccccucccauggcacgccggcgccgacaccggcacaccccacuggaacaacaaggaggccuuagucgaguucaaagacgcccacgcaaaacgacaaacagugguaguccuaggaagccaggaaggagccguccacacggcccucgcaggagcacucgaggccgaaauggacggcgcaaaaggccgccugagcucaggacaccucaaaugccgccuaaaaauggacaaacuaagacucaaaggaguaagcuacucccuuugcacagcagccuucacauucacgaagaucccagcagaaacacugcauggcacagugacaguagaaguacaauacgccggcaccgacggaccaugcaaagugcccgcccagauggccguagauaugcagacucuaacucccguaggcagacuaaucaccgcaaaccccgucaucaccgagagcacagaaaacagcaaaaugaugcuagagcucgaucccccauucggagacaguuacauaguaaucggaguaggcgagaagaaaaucacccaccacuggcaccgcaguggauccacuauaggcaaagccuuugaagcaacaguccgcggcgcaaaaaggauggcaguccuaggagacaccgcaugggauuucggcagcguaggcggagcacuaaacagccucggcaaaggcauacaccaaauauucggagccgccuucaagagccuauucggcggcauguccugguucagccaaauacuaaucggcacccuccucauguggcucggacugaacaccaaaaacgggucaaucagccucaugugccuggcacugggagggguacucauauuccuaagcaccgcaguaucagccgacguagguugcagcguagacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4987 - RNA, 2314 nt, Artificial Sequence
  ZIKV prME variant mRNA Design 1 opt
gggagaaagcuuaccaugaccucagucggcauaguaggacugcuccugacaacagcgauggccgccgagguaacucgaagaggaagcgcguacuacauguaccucgaccgaaacgacgcgggcgaagcaaucagcuucccgaccacccuaggcaugaacaaaugcuacauccaaauaauggaucugggacacaugugcgacgcaaccaugucauacgaaugucccaugcucgacgaaggaguagaacccgacgacguggauugcuggugcaacacaaccagcaccuggguagucuauggaacaugccaccacaagaaaggcgaagcccgacgauccagacgugccgucacgcuacccagccacagcacacgcaaacuccaaaccagaagccaaacauggcucgaaagccgagaauacaccaaacaccucauaagagucgaaaacuggauauuccgcaaccccggguucgcacuagcugcagcagccaucgcauggcuccuaggcuccagcacaagccaaaaagucauauaccuugucaugauccuacucauagcaccggccuacuccauacgcugcauaggcgucuccaaccgagacuucgucgaaggaaugagcggaggcaccuggguagauaucguccuggagcacggcggaugcguaaccgucauggcgcaagacaagccaaccguagacaucgagcucguaaccaccacgguuagcaacauggccgaaguccgcuccuacugcuacgaagcaagcauaagcgacauggcaagugacagcagaugccccacucaaggcgaagcguaccucgacaaacaaagcgacacacaauacguaugcaaacgaacccucguagacagaggcuggggcaacggcugcggccuauucggaaagggcucccucguaaccugcgcgaaguucgccugcucaaagaaaaugacaggcaaaucgauacaaccggaaaaccucgaauacagaauaaugcuguccguccacggaucacaacacagcggaaugauagugaaugacacaggacaugaaaccgacgagaaccgagcaaaagucgaaauaacaccaaacuccccacgggccgaagccacccucggagguuuuggcagcuuaggccucgacugcgagccacgaacgggccucgacuucucagaccucuacuaccuaacgaugaacaacaaacacuggcuuguccauaaagaaugguuccacgacauaccccuccccuggcacgccggagccgacaccggcacaccccacuggaacaacaaagaggcgcuaguagaguucaaagacgcccacgccaagagacaaaccgugguaguacuagggagccaagaaggcgcgguacacacagcacuagccggagcccucgaagccgaaauggauggagcaaaagggcgacucagcuccggccaccucaaaugccgccuaaaaauggacaaacuaagacugaagggcguaagcuacagccuaugcacagccgcauucaccuucaccaaaauacccgccgaaacccuacacggaacagucaccgucgaaguccaauacgccgguaccgacggaccgugcaagguaccggcacaaauggcaguagacaugcaaacucuaacccccguaggcagacucaucacggccaaccccguaauaaccgaaucuacagaaaacaguaagaugaugcucgaacucgacccacccuuuggcgacuccuacaucgucauaggagucggagaaaagaaaaucacccaccacuggcacaggaguggcagcacaaucgguaaagccuucgaagccacaguacgcggggcaaaacgcauggcgguccucggcgacacagcaugggacuucgggagcguaggcggcgcgcuaaacagccucggcaaaggcauccaccagaucuucggcgcggcauucaaaucacuauuuggagggaugagcugguucucucaaauccucauaggaaccuugcugauguggcugggccuaaacacgaaaaacgggagcaucagccucaugugccuugcccuagguggcguccuaaucuuccuuagcacagccgucucagccgacgucggaugcagcguggacuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4988 - RNA, 2314 nt, Artificial Sequence
  ZIKV prME variant mRNA Design 1 opt
gggagaaagcuuaccaugaccagcgucgguauaguaggccuacuacuaacaacggccauggcagccgccgugacacgcagaggaucugccuacuacauguaccuagaccgcaacgacgccggcgaagcgaucuccuucccuacuacccugggcaugaacaaaugcuacauccaaaucauggaccuaggacacaugugcgaugccacaaugucauacgaaugcccuaugcuggacgagggagucgaacccgacgacguagauuguuggugcaacaccacaagcacauggguaguauauggaacaugccaccacaaaaagggcgaagcgcgcagaagccgccgcgccgucacccuacccagccacuccacaagaaaacugcaaacgagaagccaaaccuggcucgaaucccgcgaauacaccaaacaccucauccgcgucgaaaacuggaucuuccgaaaccccggcuucgcgcuagccgcggccgcuaucgcguggcuccugggaucaaguaccagccaaaaaguaaucuaccuaguaaugauccuccucaucgcaccagccuacuccauccgaugcauuggcguaagcaacagagacuucgucgagggcaugaguggcggcaccuggguagacaucgugcuagaacacggaggcugcgucaccguaauggcccaagacaaacccacagucgacauagaacucguaacaacaacgguuucaaacauggcagaggugagaucguauugcuacgaagccagcaucagcgauauggccagcgacagccgcugcccgacacaaggagaagcguaccuggacaaacaaagcgacacccaauacgucugcaagcgaacacucguagaccgcggguggggcaacggcugcggacuauucggaaaaggaagccuuguaaccugcgcaaaguucgccugcagcaagaaaaugacaggcaaaagcauccaaccagaaaaccucgaauaccggaucaugcucagcguccauggcucacaacacagcggcaugauagucaacgacacgggccacgaaacagacgaaaaccgagcaaaaguagaaauaacccccaacuccccaagagcggaagccacccuaggcggauucggaucccucggacucgacugcgaaccacgaaccggacucgacuucucagaccucuacuaccucaccaugaacaacaaacacuggcucguccacaaagaaugguuccacgacauaccacucccauggcacgccggcgccgacacaggcacaccacacuggaacaacaaagaggcccuugucgaguucaaagacgcacacgcaaaacgccaaaccgucguaguccucggaucccaagaaggagcgguccacaccgcccucgcaggcgcccuagaagccgaaauggacggagcgaaaggacgccuaucaucggggcaccucaagugcagacucaaaauggacaaacuccgacuaaaaggcgucagcuacucacucugcaccgccgcauucacguucaccaaaauccccgccgaaacccuacacggaacagugacaguagaagugcaguacgcaggaacagacggaccaugcaaaguccccgcccagauggcaguagacaugcaaacacucacaccagugggacgccuaaucaccgccaaccccguaaucacagaaagcaccgaaaacagcaaaaugaugcuagaacucgacccacccuucggggacuccuacaucguaauaggagucggggaaaagaaaaucacgcaccacuggcaccgaagcgguuccacaaucggcaaagccuucgaagcaacaguacgcggcgcaaaacggauggcgguccucggagacaccgcaugggacuucggaagcgucggaggcgcccuaaacagucuaggcaaaggaauacaccaaauauucggugcggccuucaaaagucuauucggcggcaugagcugguucagccaaauccucauaggaacacucuuaauguggcucggccuaaauacuaaaaacggcucaauuagccuaaugugcuuagcacuaggaggcgugcucaucuuccugucaaccgccgucuccgccgacguaggcugcagcguagacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4989 - RNA, 2326 nt, Artificial Sequence
  ZIKV prME variant mRNA Design 1 opt
gggagaaagcuuaccaugcgaggcgcagacacgagcguaggcaucgucggccugcuuuuaaccacagcaauggcugcagccguaacccgacgaggaagcgcauauuacauguaccuagacagaaaugacgcaggagaagcaauaucguuccccacaacacuaggaaugaauaagugcuacauccaaaucauggaccucggacacaugugcgacgccacgaugucguacgaaugccccaugcuagacgaaggagucgaaccagacgacguggauugcugguguaacacaaccucaaccugggugguauacggcacgugccaccacaagaaaggcgaagcaagacgaucaagacgagcaguaacucuccccucccacagcaccagaaaacuccagacaagaucccaaacauggcuagaaucacgagaauacacaaaacaccugauaagagucgaaaacuggauauucagaaaccccggauucgcacucgccgcagcagccauagcauggcucuuaggcagcucaacaagccaaaaaguaaucuaccuagucaugauccuacuaaucgcgcccgcguacucgauccgcugcaucggcguaucgaacagagacuucgucgaaggcauguccggagggacgugggucgacauagugcuagaacacggcggaugcgucacagucauggcacaagacaaaccgacggucgacauagagcuaguaaccaccacaguaagcaacauggcagaagucagaaguuacugcuacgaagcauccauaucagauauggcaucagacuccagaugcccgacccagggagaggccuaccuagacaaacaaucagauacccaauacgucugcaaacgaacccugguagaccgcggcuggggaaacggcugcggccuguucggcaaggggagcuuaguaaccugcgcaaaauucgcaugcagcaagaaaaugaccggaaaaagcauccaacccgaaaaccucgaauaucgcauaaugcucagcguccacggcagccaacacagcggaaugauagucaacgacacaggccacgaaacagacgaaaacagggcaaaagucgaaaucacaccaaauagcccaagggccgaagcaacacucgggggcuucgggucacuuggccuagacugcgaacccagaacgggacuagacuucagcgaccuguacuaccucaccaugaacaacaaacacuggcuaguacacaaagaaugguuccacgacauaccccucccauggcacgcaggagccgacaccgggacgccacacuggaacaacaaggaagcacucgucgaguucaaagacgcccacgcaaagcgccaaacaguagucguacugggcucccaagaaggggcaguacacacggcacucgcaggcgcacucgaagcagaaauggacggcgccaaaggccgccucucaagcggacaccucaaaugccgccucaagauggacaagcuccgacucaaaggcguaagcuacagccuuugcacagcagcauucacauucacaaaaauacccgcagaaacacuccacggcacagucacagucgaagugcaauacgcaggaaccgacggcccaugcaagguaccagcacaaauggcagucgacaugcaaacgcuaaccccagucggccgccucauaaccgcaaacccaguaauaacugagagcacagaaaacagcaagaugaugcucgagcucgacccacccuucggcgauagcuacauagugauaggagucggcgagaaaaagaucacgcaccauuggcacagaagcggaagcacaauaggaaaagcguucgaagcaacagucagaggcgcaaaacgcauggccguccucggcgacacagcaugggacuucggcucaguaggaggggcacucaauagccuaggcaaaggaauacaccagauauucggagcggcauucaaaagccuguucggcgguaugagcugguucagccagauacuaauuggaacccuacuaauguggcuaggccuaaacaccaaaaacggaagcaucagccuaaugugccuagcacuuggcggaguacucauauuccucagcacagcagucuccgccgacguaggaugcagcgucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4990 - RNA, 2350 nt, Artificial Sequence
  ZIKV prME variant mRNA Design 1 opt
gggagaaagcuuaccaugcgagggcucucaucacgcaaacgccgcagucacgacguccuaaccguccaauuucuaauccuaggaaugcuccuaaugaccggaggggucacccgcagaggcucggccuacuacauguaccucgacaggaacgacgccggcgaagcaauuagcuuccccacaacccuugguaugaacaaaugcuacauacaaauaauggaccuaggacauaugugcgacgcaacgauguccuacgagugucccauguuggacgaaggcguagaaccagacgacguggacugcuggugcaacaccacaagcacauggguuguauacggcacaugccaccacaagaaaggagaagcccgccgaucacgacgugccgucacccugcccagccacagcacgcgcaaacuacaaacucgcucgcaaaccuggcuggaaagccgcgaauacacaaaacaccucauccgagucgagaacuggauauuccgcaaccccggcuucgcacucgcggcagccgcaauagcauggcuucuagggucaagcaccagccaaaaagucaucuaccucguaaugauccuccugaucgcccccgccuacuccaucagaugcaucggaguaucaaacagagauuucguagaaggcaugucagguggaaccuggguagacaucguacuagagcacggaggcugcgucaccgucauggcacaggauaaacccacagucgacaucgaacuggucacgaccacugucucaaacauggccgaagugcguagcuacuguuacgaagccagcaucagcgacauggcgagcgacagucgaugccccacccaaggggaagcauaccucgacaaacaaagcgacacacaauacguaugcaagcgaacacucguagaccgcggcugggggaacggaugcggacucuucggaaaaggcagccuagugaccugcgccaaauucgcuuguucaaagaaaaugaccggcaaaagcauacaaccggaaaaccucgaauacagaauaaugcucuccgugcacggaucucagcacagcggcaugauagucaacgacaccggccacgagaccgacgaaaacagggcgaaagucgaaauaacaccgaacagcccccgagccgaggcgacacucggcggcuucgggucccucggccuagauugcgaaccccgcacaggccucgacuucagcgaccucuauuaucuaacaaugaacaacaaacacuggcuaguccacaaagaaugguuccacgacauuccacuccccuggcacgcgggagcggacacgggaacaccacacuggaacaacaaagaagcacucguagaguucaaagacgcacacgccaaacgacaaaccguaguaguacuaggaagccaagaaggcgccgugcacacagcacuagcaggggcccuagaagccgaaauggacggcgccaaaggccgacuaagcaguggacaccuaaaaugccgccuaaaaauggacaaacuacgccuaaaaggagucagcuauagccuaugcacagccgcauucacguucacaaaaauucccgcggaaacgcuacacggaacuguaaccgucgaaguacaauacgccggcaccgacggaccgugcaaggucccugcacaaauggcuguagacaugcaaacacucacaccggucggccgucuaauaacagccaaccccguaaucaccgaauccaccgaaaacucaaaaaugaugcuggaacucgacccacccuucggagacaguuacauagucaucggagucggagagaaaaagaucacucaccacuggcacagaucaggcucaacgaucggaaaagccuucgaagcaacaguccgcggggcaaaaagaauggccguccuaggagacacagccugggauuucgguagcguaggaggagcccucaacucccuaggaaagggcauacaccaaauauucggagccgccuucaaaagccucuucggaggcaugucgugguucucgcaaauacuaaucggcacccuccugauguggcuagggcuaaacaccaaaaacggaucgaucucucucaugugccuagcccucgguggcgugcuaauauuccucuccaccgccgucagcgcggauguaggaugcagcguagacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4991 - RNA, 2350 nt, Artificial Sequence
  ZIKV prME variant mRNA Design 1 opt
gggagaaagcuuaccaugcgcggacucagcucccgcaaacgacgcucacacgacguacuaaccgugcaauuccucauccuugggaugcuacucaugacaggcgcggugacccgacgcggcagcgcauacuacauguaccucgaccgaaacgacgcgggcgaagcaaucagcuuccccacaacacucggcaugaacaaaugcuacauacaaauaauggaccucggacacaugugcgacgccaccaugucguacgagugcccaaugcuagacgaaggcguagaacccgacgacgucgacugcuggugcaauaccaccucaacauggguagucuacggcacaugccaccacaagaaaggagaagcccgccgcucuagacgcgccgucacucuccccagucacucaacccgaaaacuccaaacgcgcucccaaacauggcucgagucccgcgaauacacaaaacaccucauccgaguagaaaacuggaucuuccgaaaccccggauucgcacucgccgcagcagccauagcauggcuccugggaucaagcacaucccagaaaguaaucuaccucgucaugauccuacuaaucgcucccgcguacagcauacgaugcauaggcgucagcaacagagacuucguagaaggaaugucgggcggcacauggguagacaucgugcucgagcacggcggaugcguaaccguaauggcccaagacaaacccacaguagacaucgagcucguaacuaccacagucaguaacauggccgaaguccgcagcuacuguuacgaggccucaauuucagacauggccuccgacagucgcugcccaacacaaggcgaagcguaccuggacaaacaauccgacacccaauacguaugcaaacgcacccucguugacaggggguggggaaauggaugcggauuauucgguaaagggucccuaguaaccugcgccaaauucgcaugcucaaagaaaaugaccggcaaaucaauacaaccagagaaccuagaauaccgcauaaugcucagcguccacgggagccaacauuccggaaugaucguaaacgacaccggacacgaaaccgaugagaaucgcgcaaaaguagaaaucacaccaaacuccccacgggcugaggcgacacuaggcggcuucggcagccuaggccuagacugcgaaccccgcaccgggcucgacuucucggaccuguacuaccucacgaugaacaacaaacacuggcucguacacaaagaaugguuccacgauaucccccucccauggcacgccggcgccgacaccggaacaccccacuggaacaacaaagaagcccucguagaguucaaagacgcccacgccaaaagacaaacagugguuguacuagggucacaggaaggcgccguacacacagcacucgccggagcccucgaagccgaaauggacggggcaaaagguagacuaaguagcggccaccucaagugccgacucaaaauggacaagcugcgacugaaaggggucaguuacucccuaugcaccgcugcauucaccuucaccaagaucccggccgaaacccuacacggaacagucaccgucgaagugcaguacgccggcacagacggccccugcaaaguacccgcgcaaauggccgucgacaugcaaacacucacgcccgucggacggcucaucacagccaaccccguaaucacggaaagcacagagaacagcaaaaugaugcuagaacuagacccacccuucggagacuccuacauaguaaucggcguaggcgagaagaaaauuacacaccacuggcacagguccggcucaacgauugguaaagccuucgaagcaacaguccgcggugccaagcgcauggcaguccuaggcgacacagcaugggacuucggcucagucggcggcgcacucaacagucugggaaagggcauacaucagauauucggcgcagccuucaagucgcuauucggagggaugagcugguucagccagauccucaucggaacacugcucauguggcuaggacuaaacaccaaaaacgguagcaucagccucaugugccuagcacuaggcggaguccuaauauuccuuagcacggcagucagcgccgacgugggcugcagugucgacuucucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4992 - RNA, 2341 nt, Artificial Sequence
  ZIKV prME variant mRNA Design 1 opt
gggagaaagcuuaccaugcgcaucaucaacgcgcgcaaagaaaagaaacgacgcggagccgacaccucggucggaauagucggccuccuacugacaaccgccauggcagccgaggucacccgacgaggcuccgccuacuacauguaccucgaccgcaacgacgccggagaggccauuuccuuccccaccacccucggcaugaacaaaugcuacauccaaauuauggaccuaggacacaugugcgacgcaacaaugagcuacgaaugcccaaugcuagacgaagguguagaacccgacgacguagacugcuggugcaacacaacauccacaugggucguguacgguacaugccaucacaagaaaggcgaagcacgccgcagccgacgcgccguaacccucccaucccacagcacaaggaaacuucaaacacgcagccagacguggcucgaaagcagagaauacacaaaacaccucauacgaguagaaaacuggauauuucgcaacccgggcuuugcccucgccgccgcggccauagcauggcuauuaggcagcaguacgucccaaaaaguaauuuaccuagucaugauacuacuaauagcaccagccuacuccauaaggugcaucggagugucaaaccgcgacuucgucgaaggaaugagcggaggaacaugggucgacaucguccucgaacacggcgguugcgucacagucauggcccaagacaaacccacaguagacaucgaacucgucacgacaacaguauccaauauggccgaaguacgauccuacugcuacgaggcaagcauaucagacauggccuccgacucaagaugcccaacccaaggagaagccuaccucgacaaacaguccgacacucaauacgugugcaaacggacacuugucgaccgcggguggggcaacggauguggccuauucggcaaaggcagucugguaaccugcgcaaaauuugcaugcuccaagaaaaugacagggaaauccauacaacccgaaaaccucgaauacagaaucaugcucucaguccacgggucacagcacagcggcaugauaguaaacgacaccggccacgagacagacgaaaaccgcgccaaaguagaaauaaccccaaacagcccccgggccgaggccacccugggcggguucggcagccucggucucgacugcgaaccccgaacaggucuagauuucucagaccuauacuaccuaaccaugaacaacaaacauuggcucguacauaaagagugguuccacgacaucccacucccauggcacgcaggcgcggacaccgguaccccacacuggaacaacaaagaagcgcuagucgaguucaaagacgcacacgcaaaaagacaaacagucguaguccuaggcucccaggaaggagccguccacacggcacucgccggagcacucgaggcagagauggacggcgccaaaggccgccucagcucaggacaccuaaaaugccgccucaaaauggacaaacucagacucaaagggguaucauacagccuaugcacagccgcauuuacguucaccaaaauaccagccgagacacuccacggcaccguaacagucgagguccaauacgcaggaacagacggccccugcaaagucccagcccaaauggccgucgacaugcaaacacucacacccgugggccgucuaauaaccgcaaaccccguuauaacagaauccacagaaaacuccaaaaugaugcuggaacucgaucccccauucggggacagcuacaucguaaucggcguaggcgaaaagaaaaucacccaccacuggcaccgcuccggaagcacaauaggcaaagcauucgaagcaaccguccgcggagcgaaaagaauggcuguacucggagacaccgcgugggacuucggcagcgugggcggcgcacucaacucccuaggaaaaggcauccaccagauauucggcgcagccuucaaaucccuuuucggcggcauguccugguucucccaaauccuuauaggaacccuucuaauguggcucggccucaacaccaaaaacggcuccauaucccucaugugccucgcccucggcggcguacuaaucuuccuaagcacagccgucagcgccgacgucggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4993 - RNA, 2338 nt, Artificial Sequence
  ZIKV prME variant mRNA Design 1 opt
gggagaaagcuuaccaugaucaucaacgcccgaaaagaaaagaaacgacgaggcgccgacacaagcguaggcaucguaggacuccugcucacuacagccauggcagcagaagugacccgccgcggauccgccuacuacauguaccucgaccgcaacgacgccggagaggcaauaucauuccccaccacgcuaggaaugaacaaaugcuacauacaaauaauggaucucggacacaugugcgacgccaccaugagcuacgaauguccaaugcuagacgagggaguugaacccgaugacguagacugcuggugcaacaccacaucgaccugggucgucuacgguaccugccaccacaagaaaggcgaagcccgacgcucacgccgagccgucacucuacccagccacuccacaagaaaacuccaaacacgcagccaaacauggcuagaaucccgcgaauacacaaaacaccuaauacgaguagagaacuggaucuucagaaaccccggcuucgcgcucgcagcggccgccaucgcauggcucuuaggcuccagcaccagccagaaaguuaucuaccucguaaugauccuccucaucgccccagccuacuccauccgaugcauuggaguaagcaacagggacuucguagaaggaaugagcggcggaacaugggucgacauaguacucgaacacggaggcugcguaaccguaauggcacaagacaaacccaccguggacauagaacucgucacaaccaccguuuccaacauggccgaagugagaagcuacuguuacgaagccagcaucucagacauggcuuccgauagcagaugccccacccaaggagaggcauaccucgauaaacaaucagacacccaauacgucugcaaaagaacacucguagaccgcgguuggggcaacggcugcggacucuuuggcaaaggaucccuaguuaccugcgcaaaauucgccugcagcaaaaagaugacgggcaagucaauacagcccgaaaaucuggaauaccggaucaugcuaucgguccacggcagccaacacagcggcaugaucgugaacgacaccggccacgaaaccgacgaaaacagagcaaaagucgagauaaccccaaacucaccccgagcagaagccacccuaggcggauucggcagccugggccuagacugcgaacccagaaccggccuagacuucuccgaccuguacuaccucacaaugaacaacaaacauugguuaguacacaaagaaugguuccacgacauaccucuaccauggcacgccggcgcagacaccgggaccccgcacuggaacaacaaggaagcacugguagaguucaaggacgcacacgcaaaacgccaaacggucgucgugcucggcagccaagaaggagccguccacaccgcgcuagcaggagcucucgaggcggaaauggacggcgccaaaggcaggcucuccucagggcaccucaaaugccgccucaaaauggacaaacuccgacucaaagguguguccuacucucucugcacagcagccuucacauucaccaagaucccugccgaaacacuccacgggacagucacgguagaaguccaauacgccgguacagacggaccgugcaaagucccagcccaaauggccguagacaugcagacacuuaccccagucggccgccucaucaccgccaaccccgucaucacagaaagcaccgaaaacucaaaaaugaugcuggaacucgacccacccuucggugacagcuacaucguaaucggaguaggagagaagaaaauaacacaccacuggcaucgcagcggcuccaccaucggcaaagcauucgaggcuacaguaagaggagccaaacgaauggccguccuaggagacaccgcaugggacuucgggagcgucggcggcgcacuaaacagccucggaaaagggauacaucaaaucuucggcgccgccuuuaaaucauuauucggcggcaugagcugguucagccaaauauuaaucggaacgcuacucauguggcuagggcucaacaccaaaaacggauccaucucacuaaugugccuggcucucggaggcguccucaucuuccuuucaacagcaguaagcgccgacguaggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4994 - RNA, 2335 nt, Artificial Sequence
  ZIKV prME variant mRNA Design 1 opt
gggagaaagcuuaccaugaucaacgcccgcaaagagaagaaacgcagaggcgccgacacgagcguaggaaucgucggccuacuacucacuacagccauggcggccgaggucacacgcagagggucagccuacuacauguaucucgacaggaacgacgccggagaagcgaucucauuccccaccacccucggaaugaacaaaugcuacauccaaauaauggaccucgggcacaugugcgacgcuacaauguccuaugagugcccuaugcuagacgaaggcguggaaccugacgacguagauugcuggugcaacacaacuucaaccuggguaguauacggcacaugccaccacaagaaaggagaggcacgcaggagccggcgcgccgucacgcucccaucacacuccacgcgaaaacuucaaacccggagccaaacuuggcuagaaagcagagaauacaccaaacaccucauaagaguagaaaacuggaucuuccgaaaccccggauucgcgcucgcagccgcagccaucgccuggcuacucggcucgagcacaagccaaaaagugaucuaccuaguaaugauacuccuaaucgcccccgccuacucaauccgaugcaucggaguaucaaaccgagacuucguagaaggaaugucaggaggaacuugggucgauauaguacuagaacacggaggcugcgucacggucauggcccaagacaaaccaacuguugacaucgaauuaguaaccacgaccgucagcaauauggcagaggugcgauccuacugcuacgaagccuccaucucggacauggcaagcgacucacgaugcccaacccagggagaggcguaccucgacaaacaaagcgacacacaguacguaugcaaaaggacgcuagucgaccgcggaugggggaacggaugcgggcucuuuggaaaaggcucgcucguaacaugcgccaaauucgcgugcaguaaaaagaugacaggcaagagcauacaaccagaaaaccuagaauaccggaucaugcucuccguccacggcucccaacacagcggaaugauagucaacgacaccggacacgaaaccgacgagaacagagcaaaagucgaaauaacacccaacagcccccgcgccgaagcaacccuaggaggguucgggagccucggccuggacugcgaaccacgcaccggacuagacuucagcgaccuauacuaccuaacaaugaacaauaaacacuggcuaguccacaaagagugguuucacgacauaccccugccauggcacgcaggagcugacaccggaaccccacacuggaacaacaaagaagcccuggucgaguucaaggacgcccacgccaaaagacaaacaguagucguacucggcucacaagaaggcgcgguacacacagcacucgccggcgcgcucgaagccgagauggacggcgccaagggcagauuaagcagcggccaccucaagugcaggcuaaaaauggacaaacuacgacugaagggcguaucauacucacucugcacagcugcauucacauucaccaagauaccagcggaaacacuacacgggacaguaaccguagaaguacaauacgccggcaccgacggccccuguaaggucccggcccaaauggcagucgacaugcagacccuaaccccugucggaagacugaucaccgccaacccaguaaucacagaaucaacagagaacucaaaaaugaugcuggaacuggacccgcccuucggagauagcuacaucgugaucggcgucggugaaaagaaaaucacgcaccacuggcacagaagcgggagcaccauagguaaagccuucgaggcgacaguuaggggcgccaaacgaauggcaguccucggcgacacagcaugggacuucggcagcgugggcggagcacucaacucacuagggaaaggaauccaccaaauauucggcgcagcauuuaaaagccuauucggaggaaugagcugguucucacagauccuaauuggcacacuacuaauguggcuagggcucaacaccaaaaacggaagcaucagccuuaugugccucgcacucgguggaguccuaauuuuucugagcaccgccgucagugcagacgugggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4995 - RNA, 2332 nt, Artificial Sequence
  ZIKV prME variant mRNA Design 1 opt
gggagaaagcuuaccaugaacgcacgcaaagaaaagaagcgccgcggagccgacacauccguaggaaucguaggacuacuccucacaacggccauggcagccgaaguaaccagacgcggcuccgccuacuacauguaccucgaccgaaacgacgcaggagaggcuaucucauuccccacaacccucggaaugaacaaaugcuauauacagauaauggaccugggccacaugugcgacgcaacaaugagcuacgaaugcccaauguuagaugaaggcguagaacccgacgacgucgacugcugguguaacaccacaucaaccuggguaguauacggcacaugccaccacaagaaaggcgaagcgcgcagaagccgucgagcagucacacuaccaucacacucaacacgaaaacuucagacccgaucacaaaccuggcuagaaucacgagaauauacgaaacaccucauccgaguagaaaacuggaucuucagaaaccccggcuucgcccuugcagcggcggccaucgccuggcuccuagggaguucaaccagccagaagguaaucuaccucgucaugauccuccucaucgcaccagccuacagcauccgaugcaucggcgucagcaacagagacuucguagaaggaaugagcggaggcacauggguagacauaguacucgaacacggcgggugcguaaccgugauggcacaagauaaacccacagucgacaucgaacuugugaccaccaccguaagcaacauggcagaaguaagguccuauugcuacgaagcaucaauuucugacauggcauccgacagccgaugcccaacgcagggagaagccuaccuagacaaacaaagcgacacccaauacguaugcaaacgaacgcugguagaccgcggcuggggcaacgguugcggacuauucgggaaaggaagccuagucacaugcgccaaauucgccugcagcaaaaagaugacaggcaaaucaauccaacccgaaaacuuggaauacagaaucaugcuauccguccacggaagccaacacuccggcaugauagucaacgacacgggacacgaaacagacgaaaaccgugcaaaaguagaaaucaccccgaauagcccaagagcggaagccacacuagggggcuuuggcagccucggccuagauugcgaaccacgaacagggcuagauuucucggaccuauacuauuuaaccaugaacaacaaacacuggcuaguucacaaagaaugguuccacgacauaccgcucccguggcacgccggcgcagauacgggcaccccacacuggaacaacaaggaagcgcugguagaguucaaagaugcucacgccaaacgccaaaccgucguaguacuaggcucacaggaaggugcaguacacaccgcacuagccggagcacucgaagccgaaauggacggagcaaaaggacgacucagcagcggacaucuaaaaugucgacucaaaauggacaaacucaggcucaagggagucagcuacagccuaugcacggccgcauucacauucaccaaaauaccggcagaaacacuccacgguaccguaacaguagagguccaauacgccggcaccgacggccccugcaaaguaccagcacaaauggcaguagacaugcaaacccucacccccguaggacgacuaauaacggccaacccaguaauaacugaaagcaccgaaaacaguaagaugaugcuagaacuggacccaccauucggugacucauacaucgucaucggcguaggcgaaaagaaaauaacccaccacuggcaccgaagcgggucaaccauaggaaaagccuucgaagcgacagugcgcggagccaaacgcauggccguacugggcgacacagcaugggacuucggaucaguaggcggcgcccucaacagccucggcaaagggauccaccaaaucuucggagccgcguuuaaaucgcuauucggcggcauguccugguucucccaaauccucaucggcacccuacucauguggcuuggccuaaacaccaaaaauggcucaaucagccucaugugccuagcacucggaggcguccugaucuuccugucaacagcggucucggcagacgucggcuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4996 - RNA, 2329 nt, Artificial Sequence
  ZIKV prME variant mRNA Design 1 opt
gggagaaagcuuaccauggcacgcaaggaaaagaagcgccgcggagcagacaccucagucggaauagucggccugcuacucaccaccgccauggcggcggaaguaacccgccgggggucagccuauuacauguaccucgaccgcaacgacgcaggcgaagccaucucauuccccaccacgcuaggcaugaacaaaugcuacauccaaauaauggaccucggccacaugugcgacgccaccaugagcuacgaaugcccaaugcuagacgaaggcguagaacccgacgacgucgauugcuggugcaacacaacaucaacauggguugucuacggaaccugccaccauaagaaaggcgaagcacgacgcagccgcagagcaguuacacuacccucccacucgacaagaaaauuacaaacacgaucacaaaccuggcucgaaucacgagaauacaccaaacaccuaauccgcgucgaaaacuggauauuccgaaaucccggauucgcucuagcagcagccgcgaucgccuggcugcucggcuccuccacaucccaaaaagucauuuaccucgucaugauccuauuaaucgcaccggccuacucaauacgcugcauaggaguauccaacagagacuucgucgaagggaugucaggcggcaccuggguagacaucguacuagaacacggcggcugugucaccguaauggcccaagacaaaccaaccgucgacaucgaacucgucacgaccaccguaagcaacauggccgaaguacgcuccuauugcuacgaagcaagcauaucagauauggcaagcgacucccgcugcccaacacagggcgaagcauaccuggacaaacaaagugacacccaauacgucuguaagcggacccucgucgaccgcggauggggcaacggcugcggccucuucggaaaaggaucccuaguaacaugcgccaaauucgcaugcuccaagaaaaugaccggcaaguccauacaaccagaaaaccuagaauaccggaucaugcuaaguguacacggcagccaacauuccggaaugauagucaacgacacagggcacgaaaccgacgaaaaccgagcaaaaguagaaauaaccccaaacucccccagagcagaagccacacuaggcggcuuuggcucucuaggccucgacugcgaaccaagaacaggucuagacuucucagaccuuuacuaccuaacaaugaacaacaaacacuggcucguacacaaagaaugguuccacgacaucccauugccauggcacgcaggagcagacacaggaacaccccacuggaacaacaaagaagcgcuagucgaguucaaagacgcacacgccaagagacaaaccguaguaguccucggcucacaagaaggugccguccacaccgcacuagcaggcgcacuagaagccgaaauggacggagcaaaaggacgacuauccucaggacaccuaaaaugccgucucaaaauggauaaacuaagacugaaaggcguaucauacucacucugcacagcagccuucacguucaccaaaauccccgccgaaacacuacacggcacagucacaguagaaguacaauacgccggcaccgacggucccugcaagguaccagcucaaauggcggucgacaugcaaacccuaacccccguagguagacucaucacugcaaaccccgugaucaccgaaucaaccgaaaacucaaaaaugaugcuggaacuagacccaccguucggcgacagcuacauagucaucggaguaggggagaaaaagauaacccaccacuggcacagaaguggaucgaccaucggcaaagccuucgaagcaacaguucgaggcgccaaaagaauggcaguccucggagacaccgcgugggacuucggcuccguaggcggagcccucaacucccucggcaagggaauacaucagaucuucggcgccgccuucaagagccuuuucggaggaaugagcugguucucacaaauccuaauaggcacacuacucauguggcucggccucaacaccaaaaacggguccaucucccuuaugugccuggcacugggcggaguacucauuuuccucagcacugccgucagcgccgacgucggcuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4997 - RNA, 2326 nt, Artificial Sequence
  ZIKV prME variant mRNA Design 1 opt
gggagaaagcuuaccaugagaaaagaaaaaaaacgccgaggagcagacacaagcgucggcaucguaggauuacuacugacaaccgcgauggcagccgaagucacaagacgaggcucagcauacuacauguaccucgaccgcaacgacgcaggugaagcaauaagcuucccgacgacucuaggaaugaacaaaugcuauauucaaauaauggaccuaggacacaugugcgacgcaaccaugagcuacgaaugccccaugcuagacgagggugucgaacccgacgacguagacugcuggugcaacaccacaagcaccugggucgucuacggcacaugccaccacaaaaaaggagaggcacgcagaagcagaagagcagucacgcuccccucccacagcacaagaaaacuacaaaccagaucccaaaccuggcuggagucgagagaauacacaaaacaccucauaaggguagaaaacuggaucuucagaaacccgggauucgcccuagcggcagccgccaucgcauggcuccugggcucaaguacuagccagaaagugauauaccuaguaaugauacugcuaauagcacccgccuacucaauccgcugcaucggcgucucaaaccgagacuucgucgaagguaugagcggcgguacauggguagacaucguacuagaacauggcggaugcgucaccgucauggcacaggacaaacccacaguggacaucgaacuggucaccacaaccgucucuaacauggcagagguacgcuccuacugcuacgaagccucaaucucagacauggcgagcgacucccgcugucccacccagggcgaagccuaccuggacaaacaauccgauacacaauacgugugcaaacgcacacucguugaccgagggugggggaacgguugcggccucuucggcaaaggcagccuggugaccugcgcaaaauucgcgugcucgaaaaaaaugacaggcaagagcauacaaccagaaaaccuagaguaccggaucaugcuaucaguccacggaucgcaacacucaggaaugauagucaacgauacaggacaugaaaccgacgaaaaccgagcgaaaguagaaaucacacccaacagcccgcgcgccgaagcaacacuagggggcuucggaagccucggacuagacugcgaaccacgcaccggccuagacuucagcgaccuuuacuaccuaaccaugaacaacaaacacuggcuaguccacaaagaaugguuccaugacaucccgcuaccguggcacgcuggcgcagacacggggaccccacauuggaacaauaaagaagcacuagucgaauucaaagacgcgcacgcaaaacggcaaacagucgucguacuaggcagccaagagggagcuguccauaccgcgcuagccggagcccuagaagcagaaauggacggagcaaaaggccgccuuagcuccggccaccucaaaugucggcuuaagauggacaaacucagacucaagggcgucagcuacagccucugcaccgcagccuucacauucaccaaaaucccggccgaaacccuacacggaacaguaacaguagaggugcaauacgcgggaacagacgguccaugcaaagucccagcccaaauggcuguagacaugcaaacccuuaccccgguagggagacuaauaacagccaaccccguaauuacugaaucaacagaaaacagcaaaaugaugcucgaacucgacccacccuucggcgauagcuacauaguaaucggggucggagaaaaaaaaauaacacaccacuggcacagaucaggauccacaauaggaaaagcauucgaagccaccguuaggggagcaaaacgaauggcaguacucggcgacaccgccugggacuucggcagcguaggcggcgcccuaaacagccucggaaaaggaauccaccaaauauucggugcagcauucaaaagccucuucggcggcaugagcugguucagccaaauacucaucggcacgcuccuaauguggcuaggacuaaauacaaaaaacggcaguaucagccuaaugugccucgcgcuagggggcguccuaaucuuccucucaacagcagucagcgccgacgucggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4998 - RNA, 2323 nt, Artificial Sequence
  ZIKV prME variant mRNA Design 1 opt
gggagaaagcuuaccaugaaggaaaaaaaacgacgcggagcagacacaucagucggaaucguaggccuccuccugacaacagcaauggcugccgaaguaacgaggcggggaagcgcguacuacauguaccucgacagaaacgacgcaggcgaagccaucuccuucccaaccacauuaggaaugaauaaaugcuacauccaaauaauggaccucggacacaugugcgacgccacaaugucauacgaaugcccgaugcucgaugaaggcgucgaacccgaugacguagacugcuggugcaacacaacgagcacaugggucgucuacggaacaugccaccacaaaaaaggcgaggcccgacgaucacgccgagcagugacacuccccucccacagcacccgcaaauuacaaacgagaagccaaacauggcucgaaagccgcgaauauaccaaacaccugaucagaguggaaaacuggauauucaggaaccccggcuucgcccuggcagcagcagcaauagccuggcuacuuggcaguagcacaucccagaaagucaucuaccucgucaugauacuccucaucgcaccugcauacagcauccgaugcaucggcguguccaacagagacuucguagaaggcaugagcggcggaacaugggucgacauaguacucgaacacggcggcugcguaaccgugauggcucaagacaaacccacagucgacaucgagcuagucaccacgaccguaagcaacauggcagaaguacgcagcuacugcuaugaagccucgauauccgacauggcaucagacucccggugccccacccagggagaagcauaccucgacaaacaauccgacacccaguacguuuguaaacgcacacuagucgacagaggcuggggaaacggcugcggccuauuuggcaaaggcagccuggucacaugcgcaaaauucgccugcagcaaaaaaaugaccggaaaaagcauacaaccagaaaaccuggaauaccgcauaaugcuguccguccacggaagccaacacucaggcaugaucguaaacgacaccggccacgagaccgacgaaaacagagcaaaagucgaaaucacaccgaacagcccacgagccgaagcaacccucggaggguucggcucguuaggacucgacugcgaaccaagaaccggacucgacuucucagaccucuacuaccuaacaaugaacaacaaacacuggcucguccacaaagaaugguuccacgacauaccacucccauggcacgccggagccgacaccggcaccccacacuggaacaacaaagaagcccucgucgaauucaaagacgcccacgccaaacgacaaaccguaguaguccucggaagccaagaaggcgcuguacacacggcccucgcaggggcgcuggaagccgaaauggauggcgcaaaaggaagacuaagcuccggccaccuaaaaugccgucucaagauggacaaacugcgccucaaaggcgucucauauagccuaugcaccgccgcuuucacauucacaaaaauacccgccgaaacacuccacggcacaguaacagucgaaguacaauaugccggcacagacggcccaugcaaagucccagcccaaauggccgucgacaugcaaacccucacaccagucggccgccuaaucacagcaaaccccguaauaacagaaagcacagaaaacucaaaaaugaugcuagaacuggacccccccuucggcgauagcuacauagucaucggaguuggcgaaaaaaaaauaacacaccacuggcaccgcuccggcuccacgaucggcaaagcauucgaagcaacgguacgaggagcaaaaagaauggcaguacuaggagauacugcaugggacuucggcuccguggggggggcacuaaacucccuaggcaaaggcauccaccaaaucuucggcgcagccuucaaaucacucuucggcgggauguccugguucagccaaauccucaucggcacccuacuaauguggcuugggcuaaauacgaagaacggaagcauaucccucaugugccuagcacuaggcggcguccucaucuuccuuagcaccgcaguauccgcagacguaggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4999 - RNA, 2320 nt, Artificial Sequence
  ZIKV prME variant mRNA Design 1 opt
gggagaaagcuuaccauggaaaagaaaagacgaggagcagacaccagcgucggcaucgucggucuacuacucacaacagccauggccgcagaagugaccagacggggaucggcauacuacauguaccucgaccguaacgacgcaggagaagcaaucucauucccaaccacacucggcaugaacaaaugcuacauccaaauaauggacuuaggacacaugugcgacgccacgauguccuacgaaugcccgaugcuagaugaaggaguggaacccgacgacgucgacugcuggugcaacaccacgagcacguggguaguauacggaacaugucaccacaaaaagggugaagccagacgcucccgacgggcggucacccuucccucacacagcacaagaaaacugcaaacucgcagccaaacauggcuggaaucacgcgaauacacaaaacaccuuauacgggucgaaaacuggaucuuccgaaacccaggauucgcacuagcagcggccgccauagccuggcuacuaggcagcaguacuucacaaaaaguaauauaccuagucaugauacuccugauagcccccgcuuacuccauccgaugcaucggaguaagcaauagagauuucguugaaggaaugucaggaggaacauggguagacauaguccucgagcacggcggcugcguaaccgucauggcacaggacaaaccaaccguggacauagaacuggucacaacaacugucagcaacauggccgagguacgcaguuacugcuacgaggcauccaucuccgacauggcaucggacagccgaugcccgacccaaggagaggcauaccucgacaaacaaagcgacacgcaauauguauguaaacgaaccuuaguagaccgcggauggggcaacgguugcggacucuucggaaaaggcucccuggucacaugcgcaaaguucgccugcuccaagaaaaugacgggaaaaagcauccaaccggaaaaccuagaguaccgaaucaugcugucuguccacggaucccagcauuccggcaugaucgucaacgacacuggacacgaaacagacgaaaaccgagccaaaguggagauaaccccaaacagcccaagagcagaggcaacccuaggaggauucggaucccuaggacuggacugcgaaccgcgcacuggacucgacuucucagaccuauacuaccuuacaaugaacaacaaacacuggcucguccacaaagagugguuccacgauaucccccuacccuggcacgccggcgcagacacaggaacaccacacuggaacaacaaagaagcccuagucgaguucaaagacgcgcacgccaaacggcaaacaguagucguccucggaagccaagaaggggcuguacauaccgcacucgccggcgcccuagaagccgaaauggacggcgcgaaaggacgacuaagcucaggacaccucaaaugccggcucaaaauggacaaacucagacucaaaggaguuuccuacucccuaugcacagcagccuuuaccuucaccaaaauacccgcggaaacccuccacggaaccgucacagucgaaguccaauaugcgggaaccgacgggcccugcaaagugcccgcccaaauggccgucgauaugcaaacccucacccccguaggccgacuaaucacagccaaccccguaauaaccgagucaacagaaaacuccaaaaugaugcuagaacuagaucccccauucggagacagcuacauaguaaucggcguaggcgaaaagaaaaucacccaccacuggcaccgauccggaagcacaaucggaaaagccuucgaagcaaccguccguggcgccaaaagaauggccguacuuggagacacagcaugggacuucgggagcgucggaggagcacugaacagccucggaaaaggaauccaccaaaucuucggcgcagcguucaagagccuauucggcgggaugagcugguucucacaaauacuaaucggaacacugcucauguggcuaggccuaaacaccaaaaacggaucaaucagccucaugugucucgcgcugggaggaguacugaucuuccuaucaacagccguaagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5000 - RNA, 2317 nt, Artificial Sequence
  ZIKV prME variant mRNA Design 1 opt
gggagaaagcuuaccaugaaaaaaagacggggugccgacaccucgguaggaauaguaggacuccuacucaccaccgccauggcagcagaaguaacacgccgaggcagcgccuacuauauguaccucgacagaaacgacgccggcgaagccaucuccuuccccaccacacucggcaugaacaaauguuacauccaaauaauggaucucggccacaugugcgacgcaaccaugucauacgagugcccaaugcucgacgaaggagucgaacccgaugacguagacugcuggugcaauaccaccuccacaugggucguauacggaacuugccaccauaaaaaaggagaagcaagacgaucacggagagccgucaccuuacccagccauuccacccggaaacuacaaaccagaagccaaacguggcucgagagccgggaauauacaaaacaccucauaagagucgaaaauuggauauucagaaaccccggauucgcccucgccgccgcagccauagccuggcuacucggauccagcacaagccagaaagucauauaccucgucaugauacugcuaauugccccagcuuauuccauccggugcauaggcgucaguaaccgggacuucguagaaggaaugucaggagggaccuggguagacaucgugcuagaacacggaggcugcguaaccgucauggcacaagacaaaccaacagucgacauagaacugguaaccacuacagucagcaacauggccgaaguacgaucauacugcuaugaagcaucaaucagcgacauggcaagcgacagucgaugccccacgcagggcgaagccuaccuagacaaacaaucagacacacaauacgugugcaaacggacacuugucgacagaggguggggaaacggcugcggccuauucgggaaaggcagccuaguaaccugcgcgaaauucgcgugcucaaaaaaaaugaccggcaaaagcauccagccagaaaaccuagaauacaggaucaugcucagcguccacggcagccagcacagcgguaugauagucaacgacacuggccacgaaacagacgagaaccgcgcaaaaguggaaaucacaccaaacucaccacgcgccgaagcaacccucgguggguucggcucccuuggacuagacugugaaccaagaaccggccucgacuucagcgaccuauacuaccucacaaugaacaacaaacacuggcucguccacaaagaaugguuccacgacauaccccuaccauggcacgcaggcgcagacacagggacuccacacuggaacaauaaggaagcgcuagucgaauucaaagacgcccacgcaaaaagacaaaccguggucguccugggaucccaagaaggagcagugcacaccgcccucgcaggcgcucucgaagccgagauggauggagcaaaaggaagacuaagcagcgggcaccucaaaugccgacuaaaaauggacaaacuaagacuaaaaggcgucagcuacagcuuauguacggccgccuucaccuucacgaaaaucccugccgaaacccuacacggcaccguaaccgucgaaguccaauacgccggaacagacgggccguguaaaguccccgcccagauggcaguagauaugcaaacacucacccccguaggacgccuaaucacggcaaaccccgucauaaccgaaagcacagaaaacucaaaaaugaugcucgaacuagauccccccuucggagacagcuacauaguaauaggaguaggagaaaaaaaaaucacccaccacuggcacagaucaggaaguaccaucggcaaggccuucgaagccaccgucagaggagccaaacgaauggcgguccucggagacaccgccugggacuucggaagcgucggcggcgcacucaacucacuaggcaaaggcauacaccaaaucuucggagccgccuucaaaagccucuucggcggaaugagcugguucucccaaauacuaaucggcacccuacucauguggcucggucucaacaccaaaaacggcuccauaucccucaugugccuagcacucggaggcguccucaucuuccugagcaccgccgucagugccgacguaggcuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5001 - RNA, 2314 nt, Artificial Sequence
  ZIKV prME variant mRNA Design 1 opt
gggagaaagcuuaccaugaagaggagaggcgcagauacgaguguagguauaguagggcucuugcucacgaccgcaauggcagccgaagucacaagaaggggcucggcauacuacauguaccuggacaggaacgacgccggcgaagcaauaucguucccaacaacgcuagggaugaauaaaugcuacauacagaucauggaucuagggcacaugugugacgccacaaugucauacgaaugcccgaugcuggaugaaggcguagagcccgacgacguggacugcuggugcaacacgacaagcacauggguagucuacggcacaugccaucacaagaaaggcgaagcgagaagaaguaggagagcaguaacacugccaagccacucaacccgcaagcuacaaacccgaagucagaccuggcuagaaucaagagaguacacaaaacaccugauaagaguagagaacuggauauuccgaaacccaggauucgccuuggcagccgcggcaauagccuggcuauuaggcucguccaccagccaaaaggucaucuaucucgugaugauacuacuaaucgcccccgcauacucaaucaggugcauaggagucagcaaccgcgacuuuguagaggggaugucgggcgggacauggguagacaucguacuagaacacgggggcugugucacagugauggcccaagacaaacccacgguagauaucgaacucgugaccacgacaguuagcaacauggcagaaguuagaucguacugcuacgaagccagcauaagcgacauggccucagacucgcgaugcccaacgcaaggggaggcauaccuggacaaacaaucagacacccaauacgucugcaaaagaacccuagucgaccgaggcuggggcaacgggugcgggcuauucggcaaaggcagccugguaacaugugcuaaauucgcaugcagcaaaaagaugacaggcaaaaguauacagccagagaaccuggaguacaggaucaugcuaagcguccacggcagccaacacagcggcaugaucgucaacgacacaggccacgaaacugacgaaaaccgagccaaaguagagauaacacccaacagcccgcgcgcagaggcaacacugggcggguucgggagccugggacuagacugcgaaccgagaacgggccuggacuucagcgaccucuacuacuuaaccaugaacaacaaacacuggcuaguccauaaagagugguuccacgacauaccacuaccauggcacgcaggcgcagacaccgggacaccacacuggaacaacaaagaagcccuggucgaguucaaggacgcacacgccaaaagacagacagucgugguccugggcucgcaagaaggagccguccacaccgcccucgcgggagcacuagaagccgagauggacggggccaaagggcgacugagcucgggacaucucaaaugccgccuaaagauggauaaacuccgccucaaaggcguaucauacagcuuaugcaccgcggcauucacauucacaaagauccccgccgagaccuugcacgggaccgugacaguagaagugcaauacgccggaacggauggaccaugcaaagucccagcacaaauggcagucgacaugcaaacccuaaccccaguaggacgccuaauaacggcaaaccccgucaucacagaaucaaccgaaaacuccaaaaugaugcuggaacuagacccaccguuuggcgauagcuacaucguaaucggaguaggagaaaagaaaaucacacaucacuggcaccgaagcggcagcacaaucggcaaagcauuugaagcaacaguacggggcgcaaaacgaauggcaguacuuggagacaccgcaugggauuucgggagcguaggaggggcccugaacucgcuagggaaaggaauccaccaaauauucggggccgcguucaagagccuuuucggaggaaugagcugguucagccaaauucucauagggacgcuccugauguggcucgggcuaaacaccaaaaacggcucaaucagcuuaaugugccuagcacuaggaggcguccuaauauuccuaagcacagccguaagcgcagacguaggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5002 - RNA, 2311 nt, Artificial Sequence
  ZIKV prME variant mRNA Design 1 opt
gggagaaagcuuaccaugcgccguggugcagacaccucaguaggaaucguaggccuucuccuaaccacagcuauggccgcagaagucacacgacggggaucggccuacuacauguaccucgaccgcaacgacgccggcgaagcaaucagcuucccaaccacccugggcaugaacaagugcuacauacaaauaauggaccucggccacaugugcgacgcaacgaugucauaugaaugccccaugcucgacgaaggaguagaacccgacgacguagacugcuggugcaacaccaccagcaccugggucgucuauggaaccugccaccacaagaaaggcgaggcccgcaggucccgacgcgccguaacgcuacccagccacucaacucgcaaacuacaaaccagaagccaaaccuggcuagaaucccgagaauacacgaaacaccucauaagagucgaaaacuggauauuccgcaacccaggcuucgcccuggcagcagcagcaaucgccuggcuccuaggcagcagcaccucccaaaaaguaauauaccuuguaaugauacugcucauagcacccgcauacagcauacgaugcaucggagucagcaacagagacuucgucgaaggcaugagcggaggcacauggguagacaucguccuagaacacggagggugcgucacgguaauggcacaggacaaaccaacagucgacaucgaacucguuaccacaaccguaagcaacauggcagaggucagauccuacugcuacgaagcauccauaagcgacauggcauccgacagccgaugcccaacccaaggcgaggcuuaccuagacaaacaauccgacacccaguacguaugcaagcgaacucuagucgauaggggauggggcaacggaugcggacucuucggcaaaggcuccuuagugacaugugcaaaauucgccuguagcaagaaaaugaccggcaaaagcauccaaccagaaaaccuggaguaccguauaaugcucagcguacacggaagccaacacagcggcaugauagucaacgacacaggacacgaaacagacgaaaaccgugccaaaguagaaaucaccccaaacagcccacgagcugaagccacccuaggaggcuucggaagccugggacuagacugcgaaccccgcaccggccucgacuucuccgacuuauacuaccugacaaugaacaacaaacacuggcuaguacacaaagagugguuccaugacaucccacuacccuggcacgcaggagccgacaccggcacaccgcacuggaauaauaaagaagcgcucguagaguucaaggacgcccacgccaagcgacaaaccgugguaguccugggcagccaagaaggagcaguccacaccgcccuagcaggagcacuagaagccgaaauggacggagcaaaagggcgacucagcucaggacaucucaaaugccgccugaaaauggacaaacuccggcucaagggagucagcuacagccugugcaccgcagccuucaccuucaccaaaauacccgcagaaacccuccacggcaccguaacaguagaaguccaauacgcaggaaccgacggacccugcaaaguaccagcccaaauggcaguagacaugcaaacacucacacccgucgguagauuaauaacagccaacccagucauaaccgaaucgacugaaaacaguaaaaugaugcucgagcuagaucccccauucggggacagcuacauaguaaucggagucggcgagaaaaagaucacacaucacuggcaccgcagcggcagcaccaucggcaaggcuuucgaagcaacaguacgcggggcaaaacggauggccguccuaggcgacacagccugggacuucggcuccguaggcggggcacucaacagccuagggaaaggcauccaccaaaucuucggagccgccuucaaaucgcuguucggaggaaugagcugguuuagucaaauacuuauaggcacccuacucauguggcucggacuaaauaccaaaaacgguuccaucagccucaugugccuagcccuaggcgggguacugaucuuccucucaaccgccgucuccgccgacguaggcuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5003 - RNA, 2308 nt, Artificial Sequence
  ZIKV prME variant mRNA Design 1 opt
gggagaaagcuuaccaugagaggagcugacacgagcgucggcauagucggacuccuccuaaccacagccauggcagccgaaguaacacgacguggauccgccuacuacauguaccuggacagaaacgaugcaggcgaagcuaucagcuuccccaccacccucggcaugaacaagugcuacauacagaucauggaccuaggccacaugugcgacgcgacgaugagcuacgaaugcccgaugcucgacgaaggcguggaacccgacgacgucgacugcuggugcaacacaaccagcaccuggguugucuacggcacgugccaccacaagaaaggagaagcacgccgaucccgcagagccguaacccuacccucacauuccacaagaaaacuacaaacccgaagccaaacauggcuagaaagccgcgaguacacaaaacaccuaauaagaguagaaaauuggauauuccgaaaccccgguuucgcccucgcagccgccgcgaucgccuggcuacuaggauccuccacuagccaaaaaguaaucuaccucgucaugauacuacucauagccccagccuacuccauccgcugcaucggagugucaaacagggacuucguagaaggcaugagcggaggcacgugggucgacaucguacuagaacacggcgggugcgucacagugauggcccaggacaaaccaaccguagacaucgagcuagucacgaccacaguaagcaacauggcugaagucagaucguacugcuacgaagccuccaucuccgacauggcauccgacucccgcugcccaacccaaggcgaagcauaccucgacaaacaaucggacacccaauauguaugcaaacgcacacucguagacagaggauggggcaacggcugcggacuauucggaaaagggagccuagucacuugugccaaauucgccugcagcaagaaaaugaccggaaaaaguauccaacccgaaaaccuagaauaccgcaucaugcucuccguccauggaucccaacacagcggcaugaucguaaacgacaccggccacgaaacagacgaaaaccgcgccaaagucgaaaucacccccaacuccccaagagcagaggccacccugggaggauucggaucacuaggccucgauugcgaaccgcggaccggccuagacuucucagaccuguauuaccuuaccaugaacaacaagcacuggcucguacacaaggaaugguuccacgauauaccacuacccuggcacgccggcgccgacacaggcacaccccacuggaacaacaaagaggccuuagucgaguucaaagacgcccacgcaaagcgucaaaccguagucguacuuggaucgcaagaaggcgccguccacaccgcccucgcaggggcccucgaagcagaaauggacggcgcgaaagggcgccuauccagcggacaccucaaaugcagacuaaaaauggauaaacuccgccugaaaggcgucucauacucccucugcaccgccgccuucaccuucacaaaaauccccgcagaaacccuccacgggacaguaaccgucgaaguccaguacgccggaacagacggacccugcaaaguaccugcgcaaauggcaguagacaugcaaacccuaacccccgugggacgacuaauaacggcaaacccagucauaaccgaauccacagaaaacucaaaaaugaugcucgagcucgacccacccuucggcgacagcuacaucgucaucggagucggagagaaaaagauaacacaccacuggcacagauccggcagcacgaucggcaaagcauucgaagccaccguacguggagcuaaacgcauggcaguccucggagauacagccugggacuucggcuccgucggaggcgcccucaacagccuaggcaaaggaauacaccaaauauucggugcagcauucaagucccucuucggcggcaugagcugguucucacagauccucauugggacccuacucauguggcuaggucuaaacaccaaaaacggcuccaucucccucaugugccuggcacuagguggcguacucaucuuccucucgaccgcgguuucagccgacgucgggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5004 - RNA, 2305 nt, Artificial Sequence
  ZIKV prME variant mRNA Design 1 opt
gggagaaagcuuaccaugggcgcggacacaagcgucgggaucguaggccuucugcucacgaccgccauggcagccgaagucacgcgacggggaucggccuacuacauguaccuugacagaaacgacgccggugaagcaauauccuucccuaccacccucggaaugaacaaauguuauauacagaucauggaccucggccacaugugcgacgcaaccaugucauacgaaugccccaugcuagacgaaggaguggagccagacgacguggacuguuggugcaacacaacgagcacauggguaguuuacggaacaugccaucacaagaaaggagaagcuagaagauccagacgcgcagucacacuaccaucccacagcacgcgcaaacuccagacacgcagccaaacauggcuggagucaagggaauacacaaaacaccucauacgagucgagaacuggaucuuccgcaaccccggauucgcacucgcagccgcagcaauagcauggcuucucgggagcuccaccagccaaaaaguaaucuaccucguaaugauacuccuaaucgcaccagcguacuccauaagaugcauaggcguaagcaaccgagacuucgucgaaggaaugagcgguggaacguggguugacaucguacuggaacacggggguugugucacggucauggcacaagacaaaccaacgguggacaucgagcuaguaacaacgaccgucagcaacauggcagaaguccgauccuacugcuacgaagcaucaaucagcgacauggccucagacucccgaugccccacccaaggagaagccuaccuagacaagcaauccgacacucaauacgucugcaaaagaacgcuagucgaccguggauggggaaacggcugcgggcuauuuggaaaaggaucucuagucacuugcgcaaaauucgcguguagcaagaaaaugacaggaaaaagcauacaaccggaaaauuuagaauacaggauaaugcucuccguccacggcucccaacauagcggcaugaucgucaacgacacaggucacgaaacagacgaaaacagggccaaaguagaaaucacccccaacucaccgcgcgcagaagcaacacugggcggcuucggcucacuaggccucgacugcgaaccacgcacuggcuuagacuucagcgaccucuacuaccugacaaugaacaauaaacacuggcuaguccacaaagaaugguuccacgacauaccgcuaccauggcaugcaggagcggacacaggcacaccacacuggaacaacaaagaagcccucgucgaguucaaagacgcccacgcaaaaagacaaacggucguaguccuaggcucccaagagggggcaguacacacagcacucgcaggagcacucgaagccgagauggacggagcgaaaggccgacuaucaucgggacaccucaaaugcaggcucaaaauggacaaacugcggcuaaaaggagucuccuacucacucugcacagcggccuucacuuucaccaaaaucccagccgaaacccuacacggcaccgucaccguggaaguacaauacgccggcaccgacggcccgugcaagguaccagcccaaauggccguagacaugcagaccuugaccccaguaggaagacuaaucacagccaacccggucauaacagaaagcaccgagaacuccaaaaugaugcuggaacuggacccacccuucggagacagcuauaucgucauaggaguuggagagaaaaagaucacccaccacuggcaccgaagcggaucaaccaucggcaaagccuucgaagccacaguccgaggcgcaaaaagaauggccguccuaggcgacacggccugggacuucgggaguguagguggagcacucaacucacucggaaaaggcauccaccaaauauucggggccgccuucaagagccuauucggaggcaugagcugguucucgcaaauacuaaucggcacacugcucaugugguuaggccuuaacacuaaaaacggcaguaucagccuaaugugccucgcacucggaggcgugcucauauuccugagcacagcagugagcgcggacgugggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5005 - RNA, 2302 nt, Artificial Sequence
  ZIKV prME variant mRNA Design 1 opt
gggagaaagcuuaccauggcagacaccagcgucggcauaguagggcuacuacucacaacagcaauggcagccgagguaacacggcgcggcucagccuauuacauguaccucgacagaaacgacgcaggagaagcaaucagcuuccccaccacgcuaggcaugaacaaaugcuacauacaaauaauggaccuaggccacaugugcgacgcuacaaugaguuacgaaugcccaaugcuggacgaaggcguagaaccagacgacgucgacugcuggugcaacaccacuagcaccugggucgucuacggaaccugccaccauaagaaaggggaagcgcgccgcagccggcgagcgguaacacuccccagccacagcacgcgcaaacuccagacccgcagccagacauggcuagaauccagagaauacaccaaacaccuaauaagaguagagaacuggaucuuccgcaacccaggauucgcccucgccgccgcagccauagccugguuauuaggcuccuccacaagccagaaaguaaucuaccucguaaugauacuccuaaucgcacccgcauauuccauaagaugcauaggcguaagcaaccgcgacuucguugaagggaugucgggcggaaccugggucgacaucgugcucgaacacggaggaugcgucacggucauggcccaagacaaacccaccgucgacaucgaguuagucacuacaacaguguccaacauggccgagguacgcuccuacugcuacgaagcaagcauauccgacauggccuccgacagucgcugcccaacacagggagaagcauaccucgacaaacagagcgacacacaauacguaugcaaacgaacccuaguagaccgaggauggggcaacggaugcggacuauucggcaaaggcucccuagugaccugcgcaaaauucgcaugcucaaagaaaaugacgggaaaaagcauacaaccagaaaaccucgaguaccgaauaaugcuaucgguccacggcagccaacacagcggaaugauaguaaacgauaccggacacgaaacagacgaaaacagagccaaaguagagauaacucccaacagcccacgagcugaagcgacucugggaggauucggcagccugggccucgacugugaaccgcgcaccggccuagacuucucagaucuuuauuaccucacuaugaauaacaaacauuggcucguacacaaagaaugguuccaugacauaccacuaccauggcacgccggagcagacaccggcaccccacacuggaacaacaaagaggcccucguagaguucaaagacgcccacgcgaaacgacaaacagucgugguucuaggcucacaagaaggagcgguccacaccgcgcuagcuggcgcacucgaagcagaaauggacggagcaaaaggacggcucagcuccggccaccucaaaugccgacuaaaaauggacaagcuccggcugaaaggagucagcuacucccucuguaccgccgccuucaccuucacaaaaaucccagcagaaacacuacacggcacaguaacaguagagguccaauacgcggggaccgacgguccaugcaagguaccagcccaaauggcaguagacaugcagacccuaacgcccguaggacgccugauaaccgcaaacccaguaauaaccgaaagcaccgaaaacagcaaaaugaugcuggaauuagacccgccauucggcgacagcuauaucgucauuggcgucggcgaaaagaaaaucacccaccacuggcaccgcaguggauccacaauaggaaaagcauucgaggcaaccguacgaggcgcaaaacgaauggccguccucggagauacagcgugggacuucggcuccgucggcggagcacucaacagccuagggaaagguauacaccaaauauucggcgcagcuuucaaaagccuauucggaggaaugagcugguucagccaaauacuaaucggcacacuccucauguggcucggacucaacaccaaaaacgggagcauaagccucaugugccuggcgcucggaggcguacucaucuuccucucaacggcaguaagcgcagacgugggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5006 - RNA, 2299 nt, Artificial Sequence
  ZIKV prME variant mRNA Design 1 opt
gggagaaagcuuaccauggacaccuccgucggcauagugggacuccuccuuacuaccgccauggcagcggaaguaacccgacgcggcucagcauacuacauguaccuggaccgcaacgacgcaggcgaggccaucagcuuucccaccacccugggaaugaacaaguguuacauacaaaucauggaccucggccacaugugcgacgcaaccaugagcuacgaaugcccaaugcucgacgaaggaguagaacccgacgacguagacugcuggugcaacacaaccucgacaugggucguauacggaaccugccaccacaagaaaggcgaggcccgccguucacgccgagccgucacacuaccaucccacuccacaagaaaauuacaaacgcgcucacaaacauggcucgaguccagagaauacaccaaacaccuaauccgaguagaaaacuggaucuuccgaaaccccggcuucgcccucgccgcagccgcaauagcguggcuccucgguuccagcaccucccaaaaagucaucuaccuaguaaugauacuacuaaucgcuccagcuuacuccauaagaugcauaggcguauccaaccgggacuucgucgaaggcaugaguggcggcacaugggucgacaucguccuagagcacgggggcugcguaacagucauggcccaagacaaaccaacggucgacauagaacucgucaccaccacagucucaaacauggcagaaguccgcuccuacugcuacgaagcgagcaucagugacauggcaucagacagccgcugcccaacccaaggagaagccuaccuagacaaacaauccgauacucaauacgucugcaaaagaacauuaguggacagaggcuggggaaacggcugcggccucuuuggaaaaggcagccuaguaacaugcgccaaauucgcuugcucuaagaaaaugaccggcaaaucaauccaacccgaaaaccuggaguaucgcaucaugcuaagcguacacggcagccaacacagcggaaugauaguuaaugacaccggccacgaaacagacgaaaaccgcgcaaaagucgaaaucacccccaacucaccccgcgcagaagccacccuaggcgguuucggcucacucggcuuagacugcgaaccacguacaggacuagacuucucagaccuguacuaccucaccaugaauaacaagcacuggcucguccacaaagaaugguuccacgacauaccccugccauggcacgcgggagcggacaccggcacaccccacuggaacaacaaagaagcccuaguggaguucaaagacgcccacgcaaaacgccaaaccguagucguucucggaagucaggaaggggccguccacacagcccuagccggagcccucgaagcagaaauggacggugcgaaagggcgacucuccucuggacaccucaaaugccgcuuaaaaauggacaaacuacggcucaaaggagucuccuacagccucugcacggccgccuucaccuucacaaaaauccccgccgaaacacuccacggaacagucacaguagaaguccaauacgccggaaccgacggccccugcaaagucccagcacaaauggcagucgacaugcaaacacucacacccguaggcagacucaucaccgccaacccagucauaacagaaucaacagaaaauuccaagaugaugcuggaacucgaucccccauucggcgacucauauaucgucauaggagugggagaaaagaaaaucacacaccacuggcaucgcucaggaagcaccaucggcaaagcauucgaagcuaccguccgaggagcgaaacggauggccguacuaggcgacacggccugggacuucggcuccguaggcggagcccucaauucccuagggaaaggcauccaccaaaucuucggcgccgccuucaaaucccuauucggcggcauguccugguucagccaaauacuaaucggaacacuacucauguggcuaggacucaacaccaaaaacggcuccaucagccucaugugccuagcucugggcggaguccucaucuuccucagcaccgcuguauccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5007 - RNA, 2296 nt, Artificial Sequence
  ZIKV prME variant mRNA Design 1 opt
gggagaaagcuuaccaugaccagcgucgguaucguaggccuacuacuaacgaccgcaauggcugccgaaguaacaagacgcggcagcgcguacuacauguaccucgaccgaaacgacgcaggcgaagcaaucagcuucccgaccacacuaggcaugaacaaaugcuacauacaaauaauggaccucggucauaugugcgacgcaacaaugaguuacgaaugcccaaugcucgacgaaggaguagagcccgacgacgucgacugcuggugcaacaccaccagcacaugggucgucuacggaacgugccaccacaagaaaggcgaagcccgcagaucccgccgcgcagucacccuccccagccacucaacgagaaaacuccagacccggucacaaacguggcucgaaucccgagaguacacaaaacaccucauacgcguggaaaauuggaucuuccgcaaccccggcuucgcacucgccgcagccgccauagccuggcuacucggauccucaacaucccaaaaagucauauacuuaguaaugauccuacucauagcaccagcuuacagcauccgcugcauaggcguauccaacagagacuucgucgaaggaaugagcggcggaaccuggguagacauaguccuggaacacgggggaugcguaaccgugauggcacaggacaaacccacagucgacauagaacucgugacaacaacgguaaguaacauggcggaaguucgcagcuacugcuacgaagccucaaucuccgacauggcaagcgacucacggugcccaacgcagggcgaagccuaccuagacaaacagucagauacacaauacgucugcaaacgaacccucguagaccggggcuggggcaacggaugcggccucuucggaaaaggaucacucgucacaugcgcaaaguucgcaugcaguaagaagaugacgggcaaaagcauccagccagagaaccucgaauaccgcauuaugcucucaguccacggaucccaacacucaggcaugaucgugaacgacacaggacacgaaacagacgaaaaccgagcgaaaguagaaauaaccccaaacagccccagagcagaagcaacccucggcggcuucggcagucucggacuagacugcgaaccaagaacaggccucgacuucagcgaucuguacuaccuaacgaugaacaacaaacacuggcucguacacaaagaaugguuccacgacauaccacucccguggcacgcaggagcagacacgggcacaccccauuggaacaacaaagaggcccuagucgaguucaaggacgcccacgccaaacggcagaccgucgugguacuaggcucacaagaaggagcagugcacacagcacuagcaggagcacuugaggcagaaauggacggcgccaaaggucgacugucaagcgggcaccuaaaaugucgccuaaaaauggacaaacuacgccucaaaggcguaagcuauagccucugcaccgcagcguucacguucacgaaaauaccggcagagacccuacacggcacaguaacgguugaaguccaauacgccggcaccgacgggccaugcaaagucccggcccaaauggccgucgacaugcaaacgcuaacaccggucggacgccucaucacagccaacccggucaucacagaaagcacagagaacaguaaaaugaugcuagaacuagacccacccuucggcgacucauacaucguaauaggcguaggagagaagaaaauaacccaccacuggcacagaagcggcaguaccauaggcaaagcauucgaagcaaccguaagaggcgccaaacgcauggcaguacuaggcgacaccgccugggacuucggcagcguaggaggagcccuaaacucccucggcaaaggcauacaccaaauauucggcgcagccuucaaaagccucuucggcgggaugagcugguucucccagauacuaauaggcacccuacuuauguggcuaggacuaaacaccaaaaacggaagcaucagccucaugugccucgcacucggcggaguacuaaucuuccucuccacagcggucucagcagacgucggcuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5008 - RNA, 2296 nt, Artificial Sequence
  ZIKV prME variant mRNA Design 1 opt
gggagaaagcuuaccaugaccucaguuggaaucgucggccuacuucugacaaccgccauggcagccgccgucacacgcaggggcucagcauauuacauguaccuggaccgaaacgacgccggggaggccaucuccuuccccaccacccucgggaugaacaaaugcuacauccaaauaauggaccugggccacaugugcgacgcgaccauguccuacgagugccccaugcucgacgagggaguagaacccgacgaugucgacugcuggugcaacaccacgagcaccuggguggucuacggaacgugccaccacaagaaaggcgaagcccgacgcucccgcagggcggugacccuacccagccacagcacacggaaacuacaaaccaggucccagacauggcucgaguccagagaauacaccaaacaccuaauucgcgucgaaaacuggaucuucagaaacccaggauucgcccuagccgcagccgccaucgcauggcuccucggcucaagcacaagccaaaaagucaucuaccuagucaugauacugcuaaucgcccccgccuacucaauccgcugcaucggaguaucaaaucgcgauuucguugagggaaugagcggaggcaccugggucgacaucguccucgaacacggcggcugcguaacagucauggcucaagacaaaccaacaguagacaucgagcuaguaacaaccaccguaagcaacauggcagaaguacggucauacugcuacgaagcaucuauaucagacauggccucagacucacgaugcccaacucaaggggaagcauaucucgacaaacaaagcgacacccaauauguaugcaaacgaacacucguugacagaggcuggggaaacggcuguggccucuucggcaaaggcucccuugucacaugcgcaaaauucgccugcucgaagaaaaugaccggcaaaagcauacaaccagaaaaccuggaauacagaauaaugcugagcguacacggcucgcaacauagcggcaugauaguaaaugacaccggacacgaaaccgacgaaaaccgagccaaaguagaaaucacccccaauucuccccgcgccgaagccacucugggaggcuucggaucccuaggccucgacugcgaaccaagaaccggacuagacuucucagaccuauacuaccuaacaaugaacaacaaacacuggcuuguccacaaagaaugguuccacgacaucccccuacccuggcacgcaggcgccgacacaggaacgccccacuggaacaacaaagaagcacucguagaguucaaagacgcccacgcgaaacgccaaaccguagucguccugggcucacaagaaggagcaguccacaccgcgcucgccggugcacucgaagcagaaauggacggcgccaaaggccgacuaagcuccggccaucuaaaaugccgucuaaaaauggacaaacuccgccuaaaaggagucagcuacucacuguguacagcagccuucaccuucaccaaaaucccggccgagacgcuacacggcaccgucaccgucgaaguucaguacgcagggaccgacggacccugcaaaguccccgcccaaauggcgguagacaugcaaacccugaccccggucggaagacuuauaaccgcaaaccccguaaucaccgaaucaaccgagaacagcaaaaugaugcuggagcuagacccacccuucggcgacuccuacaucguaaucggcgucggcgaaaagaaaauaacccaccacuggcaccgaucgggaucaaccauaggaaaagcguucgaagcaaccguccgcggagcaaaacggauggccgugcuaggagacacagcaugggacuucggaagcguaggaggcgccuuaaacucacuaggcaaaggcauacaccaaaucuucggcgccgccuucaagagcuuauucggaggcaugagcugguucucccaaauccuaaucggcacacuccucauguggcugggacucaacaccaaaaacgggagcauaucgcucaugugccucgcccuggguggcguccuaaucuuccuaucgacagccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5009 - RNA, 2308 nt, Artificial Sequence
  ZIKV prME variant mRNA Design 1 opt
gggagaaagcuuaccaugcgcggcgccgacaccagcguaggcaucgucggacuacuccucaccacagccauggcagccgcaguaacacgacgaggaucagccuacuacauguaccuggacagaaaugacgccggcgaagccaucagcuuuccaacaacucucgguaugaacaagugcuacauacaaauaauggaccucggccacaugugcgacgcaacaaugagcuacgaaugccccaugcuagacgaaggggucgagcccgacgacguagacugcuggugcaacaccaccucaaccugggugguauacggaacaugccaccacaagaaaggcgaagcucgacgcagcagacgagccguaacacucccaagccacagcacaagaaaacuccaaaccagaagccaaacauggcucgaauccagagaauacacaaaacaccuaauuagaguagaaaacuggauauucagaaaccccgguuucgcacucgccgccgccgcaauagcauggcuacucggaagcuccaccucgcaaaaagugaucuaccucgucaugauccuacuaaucgcaccagccuacuccaucagaugcaucggagucuccaaccgagacuucgucgaaggaaugagcggcggaaccuggguagacaucgugcuagaacacggcggaugcgucacuguaauggcacaagacaaaccaacagucgacaucgaacucguaaccacaacggucuccaacauggccgaaguccgauccuacuguuacgaggccagcauaucagauauggcauccgacagccgaugccccacccaaggcgaagccuaccuagacaaacaaagcgacacccaauacguaugcaaacgcacccucguugacagaggcuggggaaacggaugcgggcuauucggcaagggcucacucgucacaugcgccaaauucgccugcagcaaaaagaugaccgggaaaagcauacaacccgaaaaccuagaauaccgaaucaugcuaucagugcacgggucacagcauagcggcaugaucgucaacgacaccggacacgagacggacgaaaacagggccaaagucgagaucacccccaacucaccgcgcgcagaagccacgcucggcggauucggcucauuaggacuggauugcgaaccacguaccggccucgacuucuccgaccucuacuaccucacaaugaauaacaaacacuggcugguacacaaagaaugguuccacgacauaccccuacccuggcacgccggagccgacacaggcacaccgcacuggaacaacaaggaagcccucgucgaguucaaagacgcccacgcuaaaagacaaaccgucgucguacuaggaagccaagaaggcgcagugcacaccgcgcuggcgggcgcacuugaagccgaaauggauggagcaaaaggaagacuaagcuccggacaccugaaaugucgccuaaagauggacaaacuaaggcuaaaaggcguaucguacucacucugcacagcagcauucacuuucacaaaaauacccgccgaaacgcuccacggcaccguaacagucgaaguccaauacgcgggaaccgacggcccaugcaaaguccccgcccaaauggccguggacaugcagacccuaaccccggugggccgccuaauaacagcaaaccccguaaucacugaaagcaccgaaaauucaaaaaugaugcucgaacucgacccacccuucggagacagcuacauagugauaggaguaggagagaaaaagauuacccaccauuggcacagaucaggcagcacaaucggaaaggcuuucgaagcaaccguacgcggagcaaaacgcauggcgguacucggcgacacagccugggacuucggcagcgucggcggcgcacuaaacuccuuaggaaaggguauccaccaaaucuuuggcgcagccuucaaaagccucuucggcggcaugagcugguucucacaaauccucauaggcacacuccucauguggcucggcuuaaacaccaaaaacggauccaucagccuaaugugccuggcacucggcggcguccuaaucuuucuaucaacugccgucagugcagacguaggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5010 - RNA, 2332 nt, Artificial Sequence
  ZIKV prME variant mRNA Design 1 opt
gggagaaagcuuaccaugcgaggccucagcuccagaaaacgacgaucacacgacguccucacgguacaauuccucauacuagguaugcuacucaugaccggaggagugacacgcagaggcagcgccuacuacauguaccucgaccgcaacgacgcaggagaggccaucagcuuccccacaacccuaggcaugaauaaaugcuacauccaaaucauggaccuaggccacaugugcgacgccacaaugucauacgaaugccccaugcuugacgaaggaguagaacccgacgacguagacugcuggugcaacacaaccagcaccugggucguauacggaacgugccaccacaagaaaggugaagcacgaagaagccgaagggcagucacccuucccagccacucaaccagaaaacuccaaacacgaucccaaaccuggcuagagagccgcgaguauacgaaacaccucauccgcgucgaaaacuggaucuucagaaacccaggcuucgcgcucgcugcagcagcaauagcauggcuccugggaagcagcaccucgcaaaagguuauauaccuagucaugauacuacugauagcacccgccuacagcauacgcuguaucggaguauccaacagagacuucgucgaaggaauguccggaggaacauggguagauauagugcucgaacacggugggugcguaaccgucauggcccaggacaaacccaccgucgacauagaacucgucacaaccacgguaucaaacauggccgaaguacgaucauacugcuacgaagcaagcauuagcgacauggcguccgacucaaggugcccaacccaaggagaagcauaccuagacaaacaaagcgacacgcaauacgugugcaagcgaacccuuguagacagaggaugggggaacggaugcggccucuucggaaaaggcagccuaguaacaugcgcaaaauucgcaugcagcaagaaaaugaccggaaaaucgauacaaccagagaaccucgaauacagaauaaugcucagcguccacgguucacagcacagcggcaugauagugaacgacacagggcacgagaccgacgaaaaucgcgcuaaagucgagauaaccccaaacagcccacgagcagaagccacccucgggggcuucggaucacuuggacuagacugcgaaccacgaaccggacuagauuucagcgaccucuacuaccuaacaaugaacaacaaacacuggcucguacacaaagaaugguuccacgauaucccguuaccauggcacgcaggagccgacacaggaacuccccacuggaacaacaaagaagcacucguggaguucaaggacgcucacgcaaaacgccaaaccguggugguccuaggaagccaggaaggagccguucacacagccuuagccggagcacuagaagcggagauggacggggccaagggccgccugagcaguggacaccucaagugccgacugaaaauggacaaacuaagacuaaaaggagucucguacagccuaugcacagcagccuucaccuucacaaagauaccggccgaaacacuacacggcacagugacaguagaaguacaauacgcaggaaccgacggccccugcaaaguacccgcccaaauggcaguagacaugcaaacccucacacccguaggcaggcuaaucacggcgaacccaguuauaacggaaagcacggagaacagcaaaaugaugcuagagcuggacccaccauuuggagacucguacauaguaaucggagucggagaaaagaaaaucacacaccacuggcaccguuccggcagcacgauaggcaaggcguucgaagcaacagucagaggcgccaagaggauggcgguacucggagacaccgccugggacuucggcucagugggcggcgcgcuaaacucacucggaaaaggcauacaccaaauauucggagccgcauucaaaagucuuuucggaggcaugagcugguucagccaaauccugauaggcaccuuacuaauguggcucggcuuaaacaccaaaaacggaaguaucucacucaugugcuuagcccugggcggaguucucauauuccuuagcaccgcagucagcgccgacguugggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5011 - RNA, 2332 nt, Artificial Sequence
  ZIKV prME variant mRNA Design 1 opt
gggagaaagcuuaccaugcgcggccucucuagccgcaaacgcagaagccacgacgucuuaacuguacaauucuuaauccucggcaugcugcuaaugacaggggcaguaacacgccgaggauccgcuuacuauauguaccuggaccggaacgacgcaggcgaagccauauccuucccaacaacccugggcaugaacaaaugcuacauacaaauaauggaccuaggucacaugugcgacgcgaccaugagcuacgagugccccaugcucgaugaaggagucgaacccgacgacgucgacugcuggugcaacaccacgucuaccuggguagucuacggaaccugccaccacaaaaagggagaagcacggcgaucuaggcgagcaguaacgcuaccaucacauagcacgcggaaacuccagacacgaucccaaaccugguuagaaagccgagaguacaccaaacaccugauaagaguagaaaacuggaucuucagaaacccaggauucgcucuagcggcagcagccaucgccuggcuccuuggaucaucaacaucucaaaaaguaaucuaccucguaaugauccuccucaucgcaccggcauacagcauacgcugcaucggcgucucaaacagagacuucguagaagggaugagcggcggcacauggguagacauaguacucgaacacggcggcugcguaaccguaauggcgcaggacaaaccaaccgucgacaucgagcuagucacgaccaccgucucaaacauggcugaaguccgaucauacugcuacgaagcaagcaucagcgauauggccuccgacaguagaugccccacccaaggagaagccuaccuugacaaacaauccgacacccaauacguaugcaagcgaacccucgucgaccgcggcuggggcaacggcugcggccuauucggcaaaggcagccucgucacaugcgccaaauucgccugcagcaagaaaaugaccggaaaaucaauacaaccagaaaaccucgaauaccgaaucaugcucagcguccacggcagccaacacuccggcaugauagucaacgacacaggccacgaaacagacgagaaccgugccaaaguagagauaacacccaacaguccccgugccgaagcaacccucggcggcuucggcucccuaggccuggacugcgaaccacgaaccggacuagacuucagcgaccuauacuaccuaacaaugaacaacaagcacuggcugguacacaaagaaugguuccacgacaucccccuccccuggcacgcgggcgccgacacgggaaccccacacuggaacaacaaagaagcccucgucgaguucaaagacgcgcacgcaaaaagacaaacagucgucguauuaggcucacaagaaggcgcaguacacacagcccuagcuggagcccucgaagcagaaauggacggggcaaaaggccgacucagcagcggacaccucaaaugccgccuuaaaauggacaaacuacgacuaaagggagucagcuacucacucugcaccgccgcauucacguucaccaaaauccccgccgaaacccuccacggaaccguaacaguagaaguacaauacgcaggcaccgacggucccugcaaagucccagcccaaauggcaguagacaugcagacacuaacgccuguagggagacuaauuacagcaaacccugucaucacggaaucaaccgagaacagcaaaaugaugcuagaacuagaucccccauucggagacaguuacaucguaauuggagucggagaaaagaagauaacgcaccacuggcacagaagcggcucaacaauaggaaaagcauucgaagccacaguccggggagccaagagaauggccguacugggggacaccgcaugggacuucggaagcgugggcggagcacuaaacagccuaggcaaagggauacaccaaauauucggcgccgccuucaaaucacucuucggaggcaugagcugguucagccagauucuuaucggcacacuacuaauguggcucggccugaacaccaaaaacgguagcauaucacucaugugccuugcccucggagguguacuaaucuuccugagcaccgccgucagcgcagacguaggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5012 - RNA, 2332 nt, Artificial Sequence
  ZIKV prME variant mRNA Design 1 opt
gggagaaagcuuaccaugcgaauaauaaacgcacgaaaagagaagaaaagaagaggcgccgacacaagcgugggaauagucggccuacugcuaacaacagccauggccgccgaagucacgcgucgaggauccgccuacuacauguaccucgaccgaaacgacgccggcgaagccauauccuucccaacaacccucggcaugaacaaaugcuacauccaaauaauggaccugggacacaugugcgacgccaccaugucauacgaaugcccaaugcuagacgaaggcgucgaaccagacgaugucgacugcuggugcaacacaacuagcacauggguaguauacggcacaugccaccacaagaaaggggaagcccgccgcagccggagggccgucaccuuaccaucccacucaacgcgcaaacuccaaacccgaagccaaacauggcucgaaucgcgagaauacaccaaacaccucauccgggucgagaacuggaucuuucgaaaccccggguucgcccuagcggcggcggcaauagcauggcuacucggcucaucaacgucucaaaaagucauuuaucuagucaugauacugcuaaucgccccagcguacucaauacggugcaucggaguaucaaaccgcgauuucguggagggcaugucaggcggaaccuggguagacauagugcuagagcacggaggcuguguuacugucauggcccaggacaaacccaccguggacaucgagcuaguaacaacaaccguauccaacauggcagaaguccguucauacugcuaugaagccuccaucuccgacauggcaucagauagcagaugcccaacacagggcgaagcauacuuagacaaacagucagacacgcaauacguuuguaaacgcaccuuagucgacagaggcugggggaacggaugcgggcuauucggcaagggcucgcuaguaaccugcgccaaauucgcaugcagcaagaagaugaccggcaaauccauacaaccagaaaaccucgaauacagaauaaugcuaucuguccacggcagccaacacagcggaaugauugucaacgacacaggccacgaaacggacgaaaaccgagccaaaguagaaaucacacccaacucaccgcgagccgaagcaacccucgggggcuucggcucccuaggacucgacugcgaaccccggaccggccucgacuucagcgaccucuacuaccuaaccaugaacaacaaacauuggcuaguccacaaagaaugguuccacgacaucccccuuccauggcaugcaggagcagacacaggcacaccccacuggaacaacaaagaagcgcuaguagaguucaaagacgcacacgcaaaacgacaaacagucgucgugcugggaucccaagaaggcgcuguccauacagcacucgcaggcgcacucgaagccgagauggauggcgcaaaaggacgacuaagcuccggacaccucaaaugcagacugaaaauggacaaacucagacuaaaaggagucucauacucccuaugcaccgccgcguucaccuucaccaaaauaccagcagaaacacuccacggaacggucaccgucgaaguacaauaugcaggcacagacggaccgugcaaagucccggcccaaauggcagucgauaugcaaacacuaaccccagucggccgccugaucacugcaaaccccguaaucacagaaagcacagaaaacuccaaaaugaugcucgaauuggacccacccuucggggauagcuacaucguaaucggcgucggcgaaaagaaaauaacacaccacuggcaccgcagugggagcacuauaggcaaagcauucgaagccaccguucgcggagccaaacgcauggccguacucggcgacacagccugggauuucggcucaguaggcggcgcccuaaacucccuagggaaaggcauccaucaaauauucggagcugcguucaaaagccuauucggaggaaugagcugguucucccaaauacucaucggcacacuacugauguggcucggccuaaacaccaaaaacggauccauaagccuaaugugccucgcacucggcggcgugcucaucuuccucagcacagccguaagcgcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5013 - RNA, 2329 nt, Artificial Sequence
  ZIKV prME variant mRNA Design 1 opt
gggagaaagcuuaccaugaucauaaacgcacgcaaggaaaagaaacgaagaggcgcugacacaagcgucgggauaguaggccuccugcuaaccaccgcaauggcagcagaagugacucgccguggcagcgcauacuacauguaccucgaccguaacgacgcaggggaagcaauaaguuuccccaccacacucggcaugaacaaaugcuacauccaaaucauggaccucggccacaugugcgacgccaccaugagcuacgagugccccaugcucgacgagggagucgaaccagacgacguagacugcugguguaacacgaccucaaccugggugguauacggaaccugccaccauaagaaaggagaagcccgccgaucccgacgcgcaguaacccuccccucacacuccacccgaaaacuacaaacacgcucacaaacauggcuggaaucacgcgaauacaccaaacaccucaucagaguagagaauuggaucuuccgcaaccccggcuucgccuuagcagccgccgccauagcauggcuacucgggagcucuaccagccaaaaggucauauaccuaguaaugauccugcuaaucgccccagcauacagcauacgcugcaucggcguauccaacagagacuucgucgaagguauguccggcggcacaugggucgacaucguccucgaacacggaggcugcgugaccgucauggcccaagauaaaccaaccgucgacauagaacucgucaccaccacaguaucaaacauggccgagguacgcucauacugcuacgaagcauccauauccgacauggcaagcgacucgaggugcccuacacagggcgaagccuaccuagacaaacaaucagacacacaauacgucuguaaacgcacccuagucgacagaggauggggaaacgggugcggccuauucgggaagggcagccugguaaccugcgcaaaauucgccugcagcaagaaaaugacuggaaaaucgauccaaccugaaaaccuggaauaccgaaucaugcuaagcguccacggaagccagcacucgggcaugaucgucaaugacacaggacacgaaacagacgaaaaucgcgcaaaaguagaaauaacccccaacucgcccagggccgaagccacgcucggcggcuucggaucgcuaggccuugacugcgagcccagaaccggacuagacuucucagaucuguacuaccuaaccaugaacaacaaacacuggcucgugcacaaagaaugguuucacgacauaccccucccauggcacgccggcgcagacacaggcacaccccacuggaacaacaaagaagcacucguagaguucaaagacgcccacgcaaaacgccaaacagucgucgugcuaggcucccaagaaggagccguccacacagcccucgccggcgcccuagaagccgaaauggacggagccaaaggacgacucucaagcgggcaucucaaaugcaggcuaaaaauggauaagcucagacuaaaaggagucagcuacucacuaugcaccgccgccuucaccuucaccaaaauacccgcggaaacacuacacggaacaguaaccgucgaaguccaauacgccggcaccgauggcccgugcaaaguccccgcucaaauggccgucgacaugcaaacauuaacgcccguaggccgccucaucacagcaaauccagucauaacggaaagcacagaaaacagcaaaaugaugcucgaacucgacccgcccuucggagacaguuacaucgucauuggcguaggcgaaaagaaaauaacacaccacuggcacagaagcggaucgaccauaggcaaagcauucgaagcaaccguccgaggcgccaaaagaauggccguacucggagauacagcaugggacuucggaucagucggcggagcccuaaacucccucggcaaagguauacaccaaaucuucggagccgccuucaaaagccucuucggaggcaugucgugguucagucaaauacucauaggaacacuacucauguggcuaggccuaaacaccaaaaacggcucuaucagccucaugugccuagcacuaggaggcguccuaaucuuccucagcacagcgguauccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5014 - RNA, 2326 nt, Artificial Sequence
  ZIKV prME variant mRNA Design 1 opt
gggagaaagcuuaccaugaucaacgcccggaaagaaaagaaaaggagaggcgcagacacaagcgucggcauagucggacuccuacucacaaccgccauggcggccgaagucacacggagaggaucggccuacuacauguaccuagaccgaaacgacgccggagaagccaucagcuuccccacaacacuaggaaugaacaaaugcuacauacaaauaauggaccuuggccauaugugcgacgccacaaugagcuaugaaugccccaugcucgacgaaggagucgagccggacgacgucgauugcuggugcaacaccacauccacaugggucgucuacggcacaugccaccacaagaaaggagaagccagacgcagcagacgagccguaacacuacccagccacucaacacgcaaacuccaaacccgaagccaaaccuggcucgagagcagagaauauaccaaacaccuaaucagggucgagaacuggauauucaggaacccaggauucgcacuagcugccgcagcaauagcauggcuacuaggcagcagcaccagccagaaagugaucuaccucguaaugauacuucucauagcacccgccuacucaauacgaugcauaggcgucagcaaccgcgacuucgucgaaggcaugucagguggaacauggguagacaucgugcucgaacacggcggcugcgucaccgucauggcccaagacaaacccaccguagacauagagcuagugaccacaacaguaagcaauauggccgaagugagaagcuacuguuacgaagccagcaucagcgacauggcguccgacucucgcugcccaacccaaggagaagcguaccuagacaaacaaagcgacacacaauacguaugcaaaaggacccucgucgaccgaggcuggggcaacggaugcggacuguucggcaaagggagccuaguaacaugcgcaaaauucgcgugcuccaagaaaaugacaggaaaaagcauacaaccagagaaccuagaauaccgcaucaugcuaagcguccacggaagccaacacucaggcaugauaguuaacgacacaggccacgagaccgaugagaaccgcgccaaaguggagaucacaccaaacuccccaagagcagaagcgacccuaggaggauucggaucgcucgggcucgacugcgagccaagaacaggccuagacuucuccgaccucuacuaccuaaccaugaacaauaaacauuggcuagugcacaaagaaugguuccacgacauaccgcucccauggcacgccggcgcugacacgggaacgccccacuggaacaauaaagaagcacuggucgaguucaaggacgcacacgccaaaagacaaaccgucguaguacucggaagccaagaaggcgccguacacaccgcacuggccggagcccuagaagcagaaauggacggcgcgaaaggaagacucagcucaggacaccugaagugccggcucaaaauggacaaacuccgacucaaaggaguaagcuacagccucugcacagccgccuucaccuucaccaagaucccggcagaaacccuucacggcaccgucacaguagaaguacaauacgcagguacagacggacccugcaagguccccgcacaaauggcaguagacaugcaaacccugacaccaguugggagacugaucaccgcaaacccagugaucaccgaaucaaccgaaaacagcaaaaugaugcuagaacucgacccaccauucggggacagcuacauaguaaucggcgugggagaaaagaaaauaacacaccacuggcaccgcucaggcaguacuauaggaaaagccuucgaggccacaguccguggggccaaaagaauggcgguacuaggcgacaccgccugggacuucggcagcguagggggcgcacuaaacucacucggaaaagggauucaccagauuuucggcgcagccuucaaaagccucuucggaggaaugagcugguucagccaaauacucauaggaacgcuacugauguggcugggccucaacaccaaaaacgggucaauaagccucaugugccuagcccuaggcggaguccuaauauuccuauccacagcagucagcgcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5015 - RNA, 2323 nt, Artificial Sequence
  ZIKV prME variant mRNA Design 1 opt
gggagaaagcuuaccaugaaugcacgaaaagaaaagaaacgacgaggagcagacacuucagucggcaucgugggccugcuacucacaacagcgauggccgccgaagucacacgccgaggcucugcuuacuacauguaccucgaucgaaacgacgccggggaagcaaucucguuccccaccacgcugggaaugaacaaauguuacauacaaaucauggaccucggccacaugugcgacgccaccauguccuacgaaugcccaaugcucgacgaaggaguagagccagacgacgucgacugcuggugcaacaccaccagcacguggguagucuacgggacgugccaccauaagaaaggagaagcacgcagaaguagacgagcagucacccuaccaagccacucaacccgcaaacuacaaaccagaucucaaacguggcucgaaagucgcgaguacacuaaacaccucauacgcgucgaaaacuggaucuuccgaaaucccggauucgcgcuggcagcagcagccauagccugguuacugggcagcuccaccagccaaaaaguaaucuaccuugugaugauccuacuaaucgcuccagccuacagcauccgaugcauaggcgucagcaaccgagacuucgucgagggcauguccggcggaaccuggguagacaucguacuagaacacggcgggugcgucacagucauggcacaagacaaacccaccgucgacauagagcuaguaaccacgacaguaagcaacauggcagaagucagaagcuacuguuacgaagcaucaauauccgacauggcaagcgacucccgaugccccacccaaggcgaagcauaccuagacaaacaaagcgacacccaguacgucugcaaaaggacccuagucgaccgaggcuggggaaacgggugcggacuguucgggaaaggcagccucguaaccugcgccaaauucgccugcucaaagaaaaugacgggcaaaagcauacaacccgaaaaccucgaauacaggaucaugcuaucuguccauggcagccaacacuccggcaugauagucaaugauacuggacacgaaacagacgaaaaccgcgccaaaguagaaaucacacccaacagcccccgcgcagaagcaacccucggaggcuucggaucccuaggccucgacugcgaaccacgcaccggccucgacuucuccgaucucuacuaccucaccaugaacaauaaacacuggcugguccacaaagaaugguuccacgacauaccccugccguggcacgccggcgccgacacaggaaccccacacuggaacaacaaagaggcgcuagucgaguucaaagacgcccacgcuaaacgacaaacggucgucguccuaggcucccaagaaggggcgguccacacagcccucgcaggagcccuggaagccgaaauggacggcgccaaaggcagacucagcuccggccaccuaaagugccgccucaaaauggacaaacuaagacugaaaggcgucagcuacagccuaugcacagcagcauucacauucaccaaaauacccgccgaaacccugcacggaacagugacaguagaaguccaauacgccggcaccgacgggcccugcaaaguaccagcccaaauggccgucgacaugcaaacgcucaccccagucggccgacugaucaccgccaacccagucaucaccgaauccacagagaacucaaaaaugaugcucgaacuagaucccccauucggcgacuccuacauaguuaucggcguuggagaaaagaaaaucacgcaccacuggcacaggagcgguucaacaauaggaaaagccuucgaagcgacaguccgcggagccaaacgaauggcgguacugggcgacacugcaugggacuucggcagcguaggcggcgcucucaacucccugggaaaaggaauacaucaaauauucggagccgcauuuaaaucacuguucggaggcaugucaugguucagccagauccuaauaggcacccuccucauguggcucggacuaaacacgaaaaauggaagcauaagccuuaugugccuagcacucggcggaguccuaauauuccucagcacggccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5016 - RNA, 2320 nt, Artificial Sequence
  ZIKV prME variant mRNA Design 1 opt
gggagaaagcuuaccauggcccgaaaagaaaaaaaacgacgaggcgccgacacauccguaggaauagucggccuccuacuaaccacggcuauggcagccgaaguaacgcgccgaggaucagccuacuacauguacuuagacagaaacgacgcaggagaagcaaucagcuucccaaccacgcucggaaugaauaaaugcuacauccaaauaauggaccuaggccacaugugugacgccacuauguccuacgaaugccccaugcuagacgagggcgucgagccagacgacgucgauugcuggugcaacaccaccagcaccugggucguguacgggacaugccaccacaaaaaaggcgaagcacgacgaucccgccgagcagucacccugccaucccauagcacaagaaaacuccaaacccgcagccagacauggcuagaaagccgagaauacacaaaacaccucauccgaguggaaaacuggaucuuucgcaacccaggcuucgcacucgcagcagccgccaucgccuggcuccuaggcucgagcaccagccaaaaagucauauaccucgucaugauacuacucauagccccggcauacuccauccgaugcauuggagucagcaaccgggacuucgucgaaggaaugagcggcggcaccuggguagacaucgugcucgaacacggaggcugcguaaccgucauggcgcaggacaaacccacaguagauaucgaacuagucaccacuacaguaagcaacauggcggaaguacgaagcuacuguuacgaggccagcauauccgacauggcaucggacagcagaugccccacccaaggggaggcauaccucgacaaacaaucagacacgcaauacguaugcaaacggacccuggucgaucgcggauggggcaacgggugcggccucuucggcaaaggcucacucgucaccugcgccaaauucgcaugcuccaagaaaaugaccggcaaaagcauacaaccagagaaccuagaauaccgaaucaugcugucaguccacgguagccaacacagcggcaugaucgucaacgacaccggacacgaaaccgacgaaaauagagccaaaguagaaaucacgcccaacagcccaagagcagaagccacccucggcggguucgguagccuaggccuugacugcgagccgcgcacaggacuggacuucagcgaccucuacuaccugaccaugaacaauaaacacuggcucguacacaaagagugguuccacgacaucccccuacccuggcacgcaggagccgacaccggcacgccacauuggaacaacaaagaagcccucgucgaauucaaagacgcgcaugcgaaaagacagacagucguaguccuaggaucacaagaaggagcgguacauacagcacuagcaggagcgcucgaagcagaaauggacggcgcaaaaggacgacuaucgucaggccaccucaaaugccgacucaaaauggacaaacuaagacucaaaggggucagcuacuccuuaugcaccgccgcauucacauucaccaaaauccccgcagaaaccuuacacggaaccgugaccgucgaaguacaauacgcaggaaccgauggacccugcaaagucccagcacagauggccguagauaugcaaacccugacaccggucggccgacuaauaacagcaaaccccguaaucacugaaucaaccgaaaacucaaaaaugaugcuagaacuugacccacccuucggcgacagcuacaucguaaucggcguaggcgagaaaaaaauuacacaccacuggcaccgauccggaagcacgaucggcaaggcauucgaagcgacgguccgaggagccaaacgaauggcaguccucggcgacacagcgugggacuucggcagcgucggcggcgcucucaacagccuaggcaaaggcauccaccagaucuucggcgccgccuucaaaucccuauucggcggcaugucaugguucagccaaauccuaauaggcacacuccucauguggcucggccucaacacaaaaaacggcucaauaagccuaaugugccucgcccucggcggcguucucauuuuccucagcaccgcagucagcgcggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5017 - RNA, 2317 nt, Artificial Sequence
  ZIKV prME variant mRNA Design 1 opt
gggagaaagcuuaccaugcggaaagaaaagaaacgccgaggcgcagacacgagcguaggaauagucggccuacuccugacgacagcaauggcagcagaaguaacacgccguggaagcgcguacuacauguaccucgaccggaacgacgcaggagaagccaucagcuucccaaccacccucggaaugaacaaaugcuacauacaaauaauggaccuaggacacaugugcgacgccaccauguccuacgagugccccaugcuagacgaaggaguagaaccagacgacguagacugcuggugcaacacaacauccacguggguaguauacggaacaugccaccacaagaaaggcgaagcacgccggagccgacgagccgucacgcugccaucccacagcacacgaaaacuacaaacccggucccagaccuggcuagaaucaagagaauacacaaaacaccucauacggguagagaacuggauauucagaaaccccggguucgcacucgcagccgccgcaauagccuggcuccugggcucaagcaccucccaaaaagugauauaccuagucaugauacugcugaucgccccggccuacuccaucagaugcaucggggucagcaacagagacuucgucgaagguaugucuggaggaaccuggguagacauaguacuagaacacggaggaugcgucacggucauggcucaggacaaacccaccguagauauagaacuggucaccacaacgguaagcaauauggccgaaguaagauccuacugcuacgaggccagcauaucagacauggcauccgacucacgcugcccaacccaaggagaagcauaccucgacaaacaaagcgauacgcaauacgugugcaaaagaacccuaguagaccgaggauggggaaacggcugcggccuguucggcaaagggucacugguaaccugugcgaaauucgcgugcucaaagaaaaugacagggaaauccauccaacccgaaaaccucgaguaccgaauaaugcuaagcguccacgggucacaacacuccggaaugaucgucaacgacacaggacacgaaacagacgaaaacagagcaaaaguagaaaucacaccgaacagcccccgugcugaggcaacacucgggggauucgggucccuaggacucgacugcgaaccacgaacgggacuagacuucagcgaccuauacuaucucacgaugaacaacaaacacuggcuagugcacaaagaaugguuccacgacaucccccuacccuggcacgcaggagccgacacuggcacaccccacuggaacaacaaagaagcacugguagaguucaaagacgcacacgccaagagacagaccguagucguacucggaagccaagagggggcggugcacacagcacucgcaggagcgcucgaagcagagauggacggggccaaaggccgacuauccagcggacaccucaaaugccgacuaaaaauggacaaacucagacuaaaaggagucuccuacagccuaugcacagcagccuucaccuucaccaagauacccgcagaaacacuccacggcaccgucaccgucgaaguacaauacgccgggaccgauggaccaugcaaagucccagcgcaaauggcaguggacaugcaaacccuaaccccagucggacgucugaucaccgcaaaucccgucaucacagaauccaccgaaaauagcaaaaugaugcuggaacuggacccacccuucggcgacaguuacauagucaucggagucggagaaaagaaaauaacacaccauuggcacagguccgggagcaccauaggcaaagcauucgaagcaacaguacgaggagccaaaagaauggccgucuugggagacacugcaugggacuucggcuccguaggaggagcacucaacagccucggaaaaggaauccaccagauauucggcgcagcauucaaaucccucuucggaggcaugagcugguucucccaaauacuuauaggcacgcuccuaauguggcuaggccucaauaccaaaaacggaagcaucucucuaaugugccucgcgcuaggaggcguccuaauauuccuaucaacagcaguuucagcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5018 - RNA, 2314 nt, Artificial Sequence
  ZIKV prME variant mRNA Design 1 opt
gggagaaagcuuaccaugaaagaaaagaaacgccgaggggcggacacaagcguggguaucgucggccuacucuuaaccaccgcgauggccgcggaggucacccgacgaggcuccgcguacuacauguacuuagaccgaaaugacgccggcgaagccauaucauuccccaccacgcucggcaugaacaaaugcuacauccaaauaauggaccucggccacaugugcgacgccaccaugaguuaugaaugccccaugcucgacgaagggguagagccagacgacguagacuguuggugcaacacaaccagcacaugggucguguacggaaccugccaccacaagaaaggcgaagcccggcgcagccgccgggcagucacacuccccagccauagcacccgcaaacuacagacccgcucgcaaaccuggcucgaaucaagagaauacaccaaacaccucauccgcgucgaaaacuggauauuucgaaaccccggauucgcccuggcagcagcagcaauagccuggcuucucggcuccagcacaagccagaaagucaucuaccucguaaugauccuauuaauagccccagcuuacuccauccgguguauaggggucuccaacagagacuucgucgaaggcauguccgguggaaccuggguagacaucguacucgaacacggaggaugcgucaccgucauggcccaagacaaacccaccguggacaucgaacucgucacaaccacagucucgaacauggccgaagucagguccuacugcuacgaagcgucaauaucagacauggcauccgacagccgaugcccaacccagggagaagcauaccuugacaaacaaucggacacccaauacgucugcaagcgcacacucguggacagaggauggggcaacggaugcggacuauuuggcaaagggagccuaguaaccugcgccaaauucgcgugcagcaagaaaaugacuggcaaaaguauccaaccagagaacuuagaauaucgaaucaugcucagcguccacggaagccaacacuccggcaugaucgucaacgacacaggccacgagacagacgaaaaccgugccaaaguagaaauaacaccaaauagcccccgagcagaggcaacccucggaggcuucgggagccuaggacucgacugcgagccgaggacgggacuagauuucagcgaccuauacuaccuaacaaugaacaacaaacauuggcuuguccacaaagaaugguuccacgacaucccacuccccuggcacgccggagccgacacuggcacaccucacuggaacaacaaagaagcacucguagaguucaaggacgcccacgcuaaacgccaaacaguuguaguacucggcagccaagaaggagccguccacacagcacucgcaggcgcccucgaagccgaaauggauggagccaagggccgacuaucgucaggacaccucaagugccggcucaagauggacaaacucagacugaaaggaguaagcuacagccuaugcaccgccgccuucaccuucaccaagauccccgcagaaacacuccacggaacagucaccgucgaaguacaguacgccggaaccgacggccccugcaaaguccccgcacaaauggccguggacaugcagacccuaacaccaguaggacgccucauaacagcaaauccaguaauaaccgagucaaccgaaaacagcaaaaugaugcuagaacuagauccacccuucggcgacuccuacauaguaaucggcguaggcgagaagaaaauaacacaucacuggcacagaucagguuccacaaucgggaaagcauucgaagccacaguccgcggagccaaaagaauggcgguacuaggcgacacagccugggacuucggaaguguagguggcgcgcucaacucccuagggaagggaauacaccaaaucuucggcgccgcauucaaaagccuauucggcggaaugagcugguucagccaaauucucauaggcacccuccuaauguggcuuggacucaauacaaagaacgggagcauaucccuaaugugccucgcccuaggcggcguccuaauauuucugagcacagcagucagcgcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5019 - RNA, 2311 nt, Artificial Sequence
  ZIKV prME variant mRNA Design 1 opt
gggagaaagcuuaccauggaaaagaagaggcgaggagccgacaccagcguagggauaguaggccuacuccucacaacagcuauggcagcagaagucacacgacgcggcagugcauacuacauguaccucgaccgaaacgaugccggcgaggccaucagcuuccccaccacacuaggcaugaacaaaugcuacauacaaaucauggaccucggacacaugugcgacgcaacaauguccuacgaaugcccaaugcucgacgaggggguagaacccgacgacguagacugcuggugcaacacgaccuccacaugggugguuuacggcacaugccaccacaagaaaggcgaagcccgacgaagccgacgugcagugacacucccaucgcacuccacacgaaaacuacaaacacgaucucaaacauggcuagaaucccgcgaauacacaaaacaccuaauacggguggaaaacuggauauucagaaaccccggcuucgcccuagcagcagccgcaauagcauggcucuuagggagcuccaccucacaaaaagucaucuaccucguaaugaucuuacuaauagcgccggccuacagcauacgcugcauagggguaagcaaccgagacuucgucgaaggaaugagcggaggcaccuggguagauaucguacuagagcacggcggcugcgucacuguaauggcacaagacaaaccuacaguagacaucgaauugguaacaacaacagucagcaacauggccgaagucagaucauacugcuacgaagcgagcauaagcgacauggcaucugacagccgcugccccacccagggcgaagccuaccucgacaaacagucagacacccaauacguaugcaaaagaacacucguagaccgaggauggggcaauggaugcggacucuucgggaaaggaagccuagucacaugcgccaaauuugcaugcucaaagaaaaugacaggaaaaucgauccaaccagaaaacuuagaauaucgaaucaugcugagcguacacggcagccaacacagcggcaugauagucaacgacacuggacacgaaaccgacgaaaaccgggcaaaagucgaaaucaccccaaacucaccaagggccgaagcaacacucggcggcuuuggaagccuaggccucgacugcgaaccccgcaccggacuagacuucucagaccuauacuaccuaaccaugaacaacaaacacuggcuaguucacaaggaaugguuccacgacauaccccucccauggcacgccggcgcagacacaggaacgccccacuggaacaacaaagaagcacucguagaguucaaggacgcccacgccaagcggcagacaguagucgugcucggaucacaagaaggagccguccacacagcccucgccggagcccuugaagcggaaauggacggcgcaaaaggacggcugucuaguggacaccuaaaaugucggcugaaaauggacaaacugcgucuaaaagguguaagcuacagccuaugcacagcagcguucaccuucaccaaaaucccggcagaaacgcuccacggaaccgucacaguagaaguacaauacgcagggacagacggcccaugcaaaguacccgcccaaauggccguagacaugcaaacacuaacaccagucggaagacucauaacagccaaccccguaaucacagaaagcaccgagaacuccaaaaugaugcuggaacucgauccucccuucggcgacagcuauauagucauaggugucggugagaagaaaauaacacaccacuggcaccgcagcggcagcacaaucggaaaagccuucgaagcaaccguucggggagcgaaacgaauggccgucuuaggcgacacagcaugggacuucggcucuguaggcggagcacugaacagccuaggcaaaggaauccaccagauauucggcgcagccuucaaaucacucuucggcgggaugucuugguucucacaaauacucauaggaacacuccucauguggcuaggcuuaaacaccaaaaacggaucgaucucgcugaugugccuagcacucggcggagugcugauauuccuaucgaccgcaguaucggccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5020 - RNA, 2308 nt, Artificial Sequence
  ZIKV prME variant mRNA Design 1 opt
gggagaaagcuuaccaugaagaaacgccgcggcgccgacaccagcguaggaaucgucggacuacuguugacaaccgcaauggccgcggaagugacacgaaggggaagcgccuacuacauguaccucgacagaaacgacgccggagaagccauauccuucccgaccacacuaggcaugaacaaaugcuacauacaaauaauggacuuaggccauaugugcgacgcaacgaugucauacgaaugcccuaugcuagacgaaggaguggaacccgacgacgucgacugcuggugcaacacgacaucgaccuggguagucuacggcacuugccaccacaagaaaggagaagcacgacgaagccgacgggcagucacgcuacccagccacuccacccgaaaacuccaaacucgcagccaaaccuggcucgaaagccgcgaauacaccaagcaccuaauacgagucgaaaacuggauauuccggaacccaggcuucgcccucgcagcagcagcaauagccuggcuccuuggaagcuccacaucccaaaaaguaauauaccuagucaugauacuccuaaucgcccccgcauacagcauccgauguaucggaguauccaaccgcgacuucgucgagggcaugagcggcggcaccuggguagacauaguccucgaacacggaggcugcgucacaguaauggcccaagacaaacccacaguagacaucgagcuggucaccacaacgguaagcaacauggccgaaguccgauccuacugcuacgaagcaagcauaucagacauggcaucagacagcagaugccccacacaaggcgaagccuaccuagacaaacaaagcgacacacaauacguaugcaaacggacguuggucgaccggggcuggggcaacggaugcggucucuucggaaaaggcagccucguaaccugcgccaaauucgcgugcucaaagaaaaugacgggcaaaucaauccaaccggaaaaucuagaguaccggauaaugcuaagcguccacggaucacagcacuccggcaugaucgucaacgacaccggacacgaaacagacgaaaaccgugcaaaaguggagaucacaccaaacagcccccgcgccgaagccacacuaggcggauucggaucccugggacuagacugcgaaccaaggacaggacuagacuucuccgaccucuacuaccucacaaugaauaacaaacacuggcuaguacacaaagaaugguuccacgacaucccacuccccuggcacgccggagcagacacaggcacaccacacuggaacaacaaagaagcacucgucgaguucaaagacgcacaugccaaacgccaaaccgucguagugcuaggaucccaagaaggagcaguccacaccgcgcucgccggagcccuggaagccgaaauggacggagcaaaagggcgccugaguuccggccaccuaaagugccgccuaaagauggacaaacuaagacucaaaggcgucuccuacagccucugcaccgcagcguucaccuucacuaaaaucccggccgaaacacugcacggaacaguaaccguggaggugcaguacgcaggcacagacggacccugcaaagugccggcccaaauggcagucgauaugcaaacacuaacgcccguaggacgacucaucacagccaaccccguaaucacagaguccacagaaaacucaaaaaugaugcuagaacuagaucccccauucggagacagcuacauagucaucggcgucggugaaaagaaaauaacacaccauuggcacagaagcggcucaaccaucggaaaagccuucgaagccacgguccgaggggcaaaacgcauggccguccuaggggacacggcaugggacuucgggagcguagggggagcccucaacucccugggcaagggaauacaccaaauauucggcgccgcuuucaaaagccucuucggcgggaugagcugguucagccaaauccucaucggaacacuucucauguggcucggucuaaacaccaaaaacggaagcauaucgcugaugugccucgcgcuuggcggcguccuuauauuccuaucaaccgccguuuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5021 - RNA, 2305 nt, Artificial Sequence
  ZIKV prME variant mRNA Design 1 opt
gggagaaagcuuaccaugaagcgccgcggagccgacacaagcguaggaauugucggccuccuucuuacaacagcgauggcggccgaaguaacccgaagaggcuccgccuacuauauguaccucgacaggaacgacgccggcgaagcaaucucauuccccacaacccugggaaugaacaaaugcuacauccagauuauggaccuaggccacaugugcgaugccaccaugucguacgaaugccccaugcuagacgaaggaguagaaccagacgacguagacugcuggugcaacacaaccagcacaugggucguauacggaacaugccaccacaaaaagggcgaagcgcgaagaagccgccgcgcagugacccucccaagccacagcacacgaaaacuccaaacacgcagccaaacauggcucgaaagccgggaauacaccaaacaccucaucagggucgaaaacuggaucuuccgaaaccccggcuucgcacucgcugcagcagcaauagccuggcuucucggauccagcaccucccaaaaagucauauaccuagucaugauacuccuaauagcccccgcauacucuauacgcugcauaggagugaguaaccgagacuucguggaagggauguccggcggaacaugggucgacaucguccuagaacacgguggcugcguaacaguaauggcacaagacaaacccacaguggacaucgagcuuguaacaaccacaguauccaacauggcagaagucagauccuacugcuacgaagccuccauaucugacauggccucagacucacgaugcccaacccaaggagaagcauaccuagacaaacaaagcgacacacaauauguaugcaaaagaacauuagucgaccgcggauggggaaacggaugcggacuuuucggaaaagguucccuagugacuugcgccaaauucgccuguucgaagaaaaugaccggcaaguccauccaaccggaaaaccuggaauaccgaaucaugcuaucuguccacggcucgcaacacucaggcaugaucguaaacgacacgggccacgaaacagacgaaaacagagccaaagucgagauaacccccaacuccccucgcgccgaagccacgcucggcggauucggaagccugggccucgacugugaaccgcgaacaggacuagacuucagcgaccucuacuaccuaaccaugaacaacaagcacuggcuaguccacaaagaaugguuccacgacaucccacucccauggcacgcaggagccgacaccggaacaccacacuggaacaacaaggaagcccucgucgaguucaaagacgcgcacgccaaacgccaaacaguggucguccuaggaucccaagaaggcgccguccacaccgcacuagcgggagcccucgaagccgaaauggacggcgcaaaaggaagacucagcucgggccaccuaaaaugcagacuaaaaauggauaagcuccgacugaaaggaguaucuuacucccuaugcacagcagcauucaccuuuacuaaaauccccgcagaaacacugcacggaacaguaaccgucgagguacaauacgcaggcaccgacggacccugcaaaguaccggcccaaauggccgucgacaugcaaacccucacaccagucggaagacucaucacggcaaaccccguaaucaccgaauccaccgaaaacucuaaaaugaugcuggagcuagacccacccuucggcgacagcuacaucgucaucggagugggagagaagaagaucacccaccacuggcaccgaagcggcagcaccaucggcaaagcauucgaggcgacuguccgcggagcgaaaagaauggccguucucggggacaccgcaugggacuucggguccgucggcggcgccuuaaacagucucggaaaaggcauacaccaaauauucggcgccgcguucaaaagccuguucggaggcauguccugguucucgcaaauacuaaucggcacccuccuuauguggcucgggcuaaacaccaaaaacggaagcauaagccuaaugugccuagcccuaggcggcgugcucaucuuccuuagcacagccguaagcgcggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5022 - RNA, 2302 nt, Artificial Sequence
  ZIKV prME variant mRNA Design 1 opt
gggagaaagcuuaccaugagacggggcgcagacacaagcgucggaaucgucggacuccuacuuacgaccgcaauggcggcugaagucacacgccgaggauccgcauacuacauguaccucgaccguaacgacgcaggcgaagccauaucauucccuacaacgcugggaaugaacaaaugcuacauccagauaauggaccuaggccacaugugcgacgcaaccauguccuacgaaugcccaaugcucgacgaaggggucgaacccgacgacguagacugcuggugcaacacaacgagcacauggguaguguacggaacaugccaccacaaaaagggggaagcccgacgauccaggagagcagugacacucccaagccacagcacaagaaaacuacagacaagaucacaaaccuggcuugaaagcagagaauacacaaagcaccuaauacgaguugaaaacuggauauucagaaaccccggcuucgcacucgcagcagccgccauagccuggcuccugggcaguucaacgagccaaaaagucauauaccuaguaaugauacugcuaaucgccccagcauacucaauacgcugcaucggcguauccaaccgagacuucguagaaggaaugucaggaggaaccuggguagacauuguacucgaacacggaggaugcguaacagucauggcccaggacaaacccacggucgacaucgaacucguaacaacaaccguaucaaacauggcagaaguacgauccuacugcuacgaagcaagcaucucugacauggccucagacucacgaugccccacccagggcgaagccuaccuagacaaacagucggacacacaauacgucugcaaacgaacacuggucgaccgcgguuggggcaacggcugcggccuguucggaaaagggagccuagugaccugcgccaaauucgccugcagcaagaaaaugaccggcaaaucgauacaacccgaaaaccuugaguacagaaucaugcuauccguccacggcagccaacauuccggcaugauagucaacgacaccggccacgaaacagacgaaaacagagcaaaagucgaaaucacgcccaacuccccacgggcggaagccacacugggaggauucggcagccucggccuagauugcgaaccacgcacaggguuagacuucuccgaccucuacuaccuuacaaugaacaacaaacauuggcucgugcacaaagaaugguuccaugacaucccacuccccuggcaugcaggcgccgacacggggacaccacacuggaauaacaaggaggcgcuuguggaguucaaggaugcgcacgccaaacgacaaacaguaguuguccuaggcucacaagaaggcgcgguccacacagcccucgccggggcacuagaagccgaaauggacggcgccaaagggcgacucagcagcggccaccucaaaugccgacuaaaaauggacaaacugcgccuaaaaggggucagcuacagccucugcaccgccgcauucaccuucacaaaaauaccagccgaaacccuacacggcacagucacaguagaaguacaauacgccggcacagacggacccugcaaagucccagcccaaauggcggucgacaugcaaacccucacgccaguaggccgacuaaucacagcaaacccagucaucaccgagagcacagaaaacagcaaaaugaugcuagaacuggacccgccauuuggagauaguuacaucguaauuggcgugggggaaaagaaaauaacacaccacuggcacagaagcggcuccacaaucggaaaagcauucgaagcuaccguccgaggagcgaaacgaauggccguacucggcgacacagccugggacuucggcucaguaggcggagcccugaacucccucggcaaaggaauacaccaaaucuucggggccgcguucaaaucccuguucggaggaaugagcugguucucacagauacucauaggcacacuacuaauguggcuaggccuaaacacaaagaacggcagcauuagcuugaugugccuagccuugggaggcguacuaauauuccuaagcacagccguaucagccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5023 - RNA, 2299 nt, Artificial Sequence
  ZIKV prME variant mRNA Design 1 opt
gggagaaagcuuaccaugcgaggagccgauacuucggucggcauagucggccuacuccuaaccacggccauggcugcagaagucacaagacggggcucagccuacuacauguaccucgacagaaacgaugcaggagaagcaaucucguuccccacaacacugggcaugaacaaaugcuauauacaaaucauggaucuuggccacaugugcgacgcaaccaugagcuacgagugcccaaugcucgacgaaggcgucgaacccgaugacguggacugcuggugcaacacaaccagcacaugggucguauacggaaccugccaccacaagaaaggcgaagcccgccgaucacggcgcgcagugacccuccccucacacuccacccgaaaacuacaaacaagaagccaaaccuggcucgaaucacgcgaguacaccaaacaccuaaucagaguagaaaacuggauauuccgcaacccaggcuucgcacuggccgccgcggcaauagcauggcuccuuggcucaagcacaucacaaaaaguaauuuaccucguaaugauacuacucaucgcccccgccuauagcauccgcugcaucggcgucucaaaucgcgacuucguagaaggcaugagcggcggaacauggguagacaucguccucgaacacggagguugcgucacggucauggcccaagacaaacccacaguagacaucgagcuagucaccacgacagucucuaacauggcugaaguacgaagcuauugcuacgaagcgaguaucuccgacauggcaucagacucacguugccccacccaaggagaggccuaccucgacaaacaauccgacacacaauacgucugcaaacgcacccucguagacagaggaugggggaacggcugcggacuguucggcaaaggaagccucguaacaugcgcaaaauucgcaugcucaaagaaaaugaccggaaaaucaauacaaccagaaaaccucgaauaccgcauaaugcuauccguacacggcucccaacacuccggaaugauaguaaacgacaccggccacgaaaccgacgagaaccgagcaaaagucgagaucaccccuaacuccccacgcgcagaagcaacccuaggcggcuucggcucccucggacuggacugcgaacccagaaccggacuggacuucucagaccucuacuaccucacaaugaacaacaaacacuggcucguucacaaggagugguuccacgacaucccccuccccuggcacgcaggcgcggacacagguacgccacacuggaacaauaaggaggcacucgucgaguucaaagacgcacacgcaaaacgccaaacugucgucguacugggcucccaagaaggagccguacacacagcccucgccggggcacucgaagccgaaauggacggcgccaagggacgacuaagcuccggccaccucaaaugccgacuaaaaauggacaagcuacggcucaaaggcgucucguacagccucugcacagcggccuucaccuucaccaaaauccccgccgaaacucuacacggcacagucaccguagaaguccaguacgcaggaaccgacggccccugcaaggugccagcacaaauggccguagauaugcaaacccuuacccccguaggccgccucauuaccgccaaccccgugauaaccgagagcaccgaaaacagcaaaaugaugcuagaacucgaucccccauucggcgacaguuacaucgucaucggcgucggagagaagaaaaucacacaccacuggcacagauccgguucaacaauaggaaaagccuucgaagcaaccguccgcggagccaaacgcauggcaguacucggcgacaccgcaugggacuucggauccgucggaggagcccuaaacucccucggcaagggaauacaccaaaucuucggcgccgccuucaaaagccucuucgguggaaugucaugguucagccaaauccugaucgggacacuucuaauguggcuuggccuaaacaccaaaaacggcagcaucagucucaugugucuagcccucggcggaguacucauauuccuaucaacagcaguauccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5024 - RNA, 2296 nt, Artificial Sequence
  ZIKV prME variant mRNA Design 1 opt
gggagaaagcuuaccaugggggcggauaccuccguaggaauagucggacuacuacucacuaccgcaauggccgcagagguaacacgacgcggcagcgccuacuacauguaccuagaccgaaacgacgcaggagaagcaaucagcuuccccacgacacugggaaugaacaagugcuacauacagaucauggaccucggccacaugugcgacgcaaccaugagcuacgaaugcccaaugcuagacgaaggaguagaacccgacgacguagacuguugguguaacaccacaagcaccugggucgucuacggaacaugccaccacaagaagggagaggcccgccgcagcagacgagccguaacacuacccucgcacagcaccagaaaacuacagaccagaagccaaacauggcuagaaagcagagaauacacaaaacaccuaauccggguagaaaacuggauauuuaggaacccgggauucgcacuagcagccgcagcaauagcauggcuacuagggagcucaaccucccaaaaaguaauauaccuagucaugauccuacucaucgcgccagcauacuccauccggugcauaggaguaucaaacagagauuucguagaaggcaugucagggggcaccuggguagacauaguccucgaacacggagggugcguaacggugauggcacaagauaaaccaaccguagacaucgagcuaguaacaacaacagucagcaacauggccgaaguaaggucguacugcuacgaagccaguaucucagacauggccagcgacucacgaugcccaacccaaggagaagccuaccuagacaaacaguccgacacacaguacguaugcaaacgcacgcucgucgaccgaggcuggggaaacggcugcggccuguucggaaaagggagccuggucacaugcgcaaaauucgccugcuccaagaaaaugaccggaaaauccauacaacccgaaaaccuagaauaccggaucaugcucaguguccacggcagucagcauagcggcaugaucguaaacgacaccggacacgaaacagaugaaaaccgagcaaaagucgaaauaaccccaaacucgccccgagcagaagccacauuaggcggcuucggaucccuaggacuagacugcgaaccccgaaccggacucgacuucucagaccuguauuaucucacgaugaacaacaaacacuggcugguacacaaggaaugguuccacgacauaccacuaccauggcacgcuggagcugacaccggaacaccacacuggaacaacaaagaggcccuaguagaguucaaagaugcacaugccaaacgccaaaccgugguaguccuagggucccaagaaggagccgugcacaccgcacucgccggcgcacuggaagcagaaauggacggagccaaagggcgacuaagcuccggccaccuaaaaugcagacucaaaauggacaaauuacgacuuaaaggcguaagcuauucacugugcacggcggcauucacauucaccaaaauacccgccgaaacccuacacggaacagucaccguagaaguccaauacgccgggacagacggaccgugcaaagucccagcccaaauggccguagacaugcaaacacucacccccguaggaagacucauaaccgcaaacccggucaucaccgaaucaaccgaaaacagcaaaaugaugcucgaacuagacccgcccuucggggacagcuauauagugauaggcguaggagaaaagaaaauaacgcaccacuggcaccgaagcggcagcacaauagggaaagccuucgaagccacaguacgaggagcgaaaagaauggcaguccugggagacaccgcgugggacuucggaucgguaggaggcgcacuaaacagccugggaaaaggaauacaccaaaucuucggcgccgccuucaaaucacucuucggcggaaugucaugguucucccagauacuaaucgggacccuccugauguggcuaggucuaaacaccaaaaauggcucaaucucacuaaugugccuagcgcuaggaggcguccucaucuuccuguccacagccguaucggccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5025 - RNA, 2293 nt, Artificial Sequence
  ZIKV prME variant mRNA Design 1 opt
gggagaaagcuuaccauggcagacaccaguguaggcaucguaggacuccuacuaaccacagcaauggccgcugaagucacacgacgcggaagcgcauacuacauguaccuagaccguaacgacgccggcgaagcaaucucguuccccacgacccucggaaugaacaaaugcuacauucaaauuauggaccuagggcacaugugcgacgcgacaaugagcuacgaaugccccaugcucgacgaaggcguggaaccagacgacgucgacugcuggugcaacacaacaagcacauggguggucuauggaaccugccaucacaagaaaggcgaagcacgaagaagccgccgggcaguaacacuuccgagucacagcacccgaaaacuccaaacacgcagccaaacauggcuagaaagccgcgaauauacgaaacaccuaaucagaguagaaaacuggauauuccgaaacccuggcuuugcacucgccgcagcagccauagcauggcuccugggcagcagcacaagccaaaaagucaucuaccuagucaugauacuccuuaucgcccccgcauacucaauccgcugcaucggcgucucgaacagggacuucguggagggcaugagugggggaaccuggguagacaucguccuagaacacggcggcugcgucacgguaauggcacaggacaaaccaacaguagauauagagcuaguaaccacuacaguauccaacauggcagaaguccgcagcuacugcuacgaagcaucgauaucggacauggccagcgauuccagaugcccaacccaaggggaggccuaccucgacaaacaaagcgacacccaguacguaugcaaaagaacacucguggacagaggguggggcaacggcugcggacuauucggcaagggaucacugguaaccugcgccaaauucgccugcuccaagaaaaugaccggcaaaagcauacagccagaaaaccuagaauacagaaucaugcucuccguacacggcucgcaacacagcggaaugaucguaaacgacacaggacacgaaacagacgaaaaccgcgcaaaagucgaaaucaccccgaacuccccgcgcgcagaagcaacacuaggcggcuucggaagccucggacuagacugcgaaccucgaaccggccucgacuucagugaccucuacuaccucacaaugaacaacaaacacuggcuaguacacaaagaaugguuccacgacaucccccuacccuggcacgcgggcgcagacacaggcacaccacacuggaacaacaaagaagcccugguggaguucaaggacgcccacgcaaaacgacaaaccgucgucguacuugggagucaagaaggcgcaguacacacagcacucgccggagcacucgaagccgaaauggacggugccaaaggacgccugagcagcggccaccucaagugcagacuaaagauggacaaacuaagacucaaaggagugagcuacagccuuugcaccgcagccuucaccuucacaaaaauaccggccgaaacccugcacggaacggucaccguagaaguccaguacgccggaacugacggacccugcaaggucccagcacaaauggcgguagacaugcaaacccuaacaccaguagggagauuaauaaccgccaaccccguaaucacagaaagcacggaaaacagcaagaugaugcuagaacucgacccgcccuucggggacagcuacauaguaauaggagucggagaaaagaagaucacccaccacuggcaccgaagcgggagcaccaucgguaaagcguucgaagcaacaguacgcggcgccaaacgcauggccguacucggugacaccgccugggacuucggcucggucggcggggcccucaauagccuuggcaaaggcauucaccaaaucuucggcgccgcauucaaaagccuauucggcggaaugagcugguucagccagauacucauagguacacuucuaauguggcucgggcucaacaccaaaaacggcucaaucagccuaaugugccuggcccucggaggagugcuaaucuuccuaagcacagccgucagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5026 - RNA, 2290 nt, Artificial Sequence
  ZIKV prME variant mRNA Design 1 opt
gggagaaagcuuaccauggacacaagcgucggcaucguaggacuacuacucacaacagccauggcagcugaagucaccagacgcggcuccgcauacuacauguacuuagaccgcaacgacgccggcgaagccaucucauucccaacaacacugggaaugaacaaaugcuacauccaaaucauggaccucggacacaugugcgacgcaacgaugucauaugagugcccuaugcuggacgaaggagucgaaccagacgacguagacugcuggugcaacaccacgagcacgugggucguauacggcacuugccaccacaagaaaggggaagcccgccgcucacgccgagccguaacccuaccaucccacucaacccggaaacuacaaacacgcucccaaacauggcuagaaagcagagaguacacaaaacaccugauacgcgucgaaaacuggauauuccgaaaccccggauucgcccucgccgcugccgccauagccuggcuccugggcagcuccaccucacagaaagucaucuaucucguaaugauccuacucaucgcccccgcauacagcauacgaugcauaggcgucucaaaccgcgacuucgucgaaggaauguccggaggcaccuggguugauaucguccuagaacacgguggaugcguaaccgucauggcacaagauaaacccaccgucgacaucgaacucguaacaaccacagucucgaacauggccgaaguacgauccuacugcuacgaagccagcaucucggacauggccuccgacagccgcugccccacccaaggcgaagcauaccucgacaaacaaagcgacacucaauacguaugcaagcggacacuuguagaccgaggcugggggaacggcugcggacucuucggcaaaggcagccuuguaacgugcgcaaaguucgccugcucaaagaaaaugaccggaaaauccauacaacccgaaaaccuugaauaccgaauaaugcuaagcguccacggaucgcaacauuccggaaugaucgucaacgauaccggccacgaaaccgacgaaaaccgagcaaaagucgaaaucacacccaacagcccccgcgcagaagccacccuagggggcuucggaagccucggacuagacugcgaaccgcgcacaggccucgacuucagcgaccuguacuaccucaccaugaacaauaaacacuggcuaguccauaaagagugguuccacgauauccccuuaccauggcacgcaggagcagacaccggcaccccacacuggaacaacaaagaggcacucgucgaguucaaagacgcacacgccaaacgccaaaccgucgucguacucggcucacaagaaggcgccguccauacagcccuggcgggagcccuagaagcagaaauggacggagccaaaggcagacuaagcucgggccaccucaaaugccgccuaaaaauggacaaacucagacucaaaggaguaagcuacucuuuaugcaccgccgcguucacauucacaaaaauucccgcagaaacccuccacggaacaguaaccguagaaguacaauacgccggcaccgacggccccugcaaagucccggcccagauggccguugacaugcaaacccuaacacccgucggcagacuaauaaccgccaacccaguaaucaccgaauccacggaaaacucaaaaaugauguuagagcuagauccaccguucggagacagcuacaucgugaucggcgucggcgaaaagaaaauaacccaccacuggcaccgcagcggaagcaccauaggcaaagccuucgaagccaccguccgaggggcgaaacgcauggcgguccuaggagacacagcuugggacuucggcagcguaggcggagcgcuaaacucacucggcaaaggcauccaccaaaucuucggcgcggcauucaaaucguuguucggaggaaugucaugguucucacagauacucaucggcacacuccugauguggcuaggccucaacaccaaaaauggcucaauaagccuaaugugccuagcacucggcggcguccuaaucuuccugagcacagccgucagcgcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5027 - RNA, 2287 nt, Artificial Sequence
  ZIKV prME variant mRNA Design 1 opt
gggagaaagcuuaccaugacaagcguaggaauugucggacuccuacuaacaaccgcgauggcagcagaaguaacgcgacgcggcucagccuacuacauguaccuagaccgaaacgacgccggagaagccaucucauucccgaccacacucgggaugaauaaauguuacauacaaauuauggaccuaggccacaugugcgacgcaaccaugucguacgaaugcccgaugcucgacgagggagucgaaccggacgacguagacugcuggugcaacaccacguccacaugggucgucuacgggaccugccaccacaagaaaggagaagcacgacgaagccgacgggcgguuacccuaccaagccacagcacacgcaaacuccaaacacgcagucaaaccuggcucgaaucccgagaauacaccaaacaccuaauacgcgucgagaacuggaucuucaggaauccaggauucgcccucgcagcagcagccaucgcauggcuccugggcucgagcacuagccaaaaaguaauauacuuaguaaugauccuacugaucgcccccgcauacucaauacgaugcaucggcguaagcaaccgcgacuucgucgaaggcaugucaggaggaacauggguagacauaguccucgaacacgggggcugcgucacgguaauggcacaggacaaaccaacagucgacauagagcuagugaccaccacagucaguaacauggcggaaguccgaucguacugcuacgaagccagcauaucagacauggccucagacucacgcugccccacacagggagaggccuaccucgacaagcaaagcgacacacaauaugucugcaaaagaacauuagucgaucgcggguggggcaacgggugcggccucuucggcaaaggcagucucguaacaugcgcaaaauuugcaugcuccaagaaaaugacaggaaaauccauacaacccgaaaaucucgaguacagaaucaugcuauccguccacggcucccaacauagcgggaugauagugaacgacacgggccacgaaacagacgaaaaccgagccaaagucgaaauaacacccaacaguccccgcgcagaagcaacacuaggcggguucggcagccuaggcuuagacugcgaaccacgcacaggcuuagacuucagcgaccuauacuaccucaccaugaacaacaaacacuggcugguccacaaagagugguuccacgacaucccacuccccuggcaugcaggagcugacacgggcaccccacacuggaacaacaaagaggcucucguagaguucaaagacgcacacgcaaaacgacaaacagucgugguccuaggcucacaagaaggagcgguacauaccgcacuagccggagcccucgaggccgaaauggacggagcgaaggggcgccuaagcucaggacaccuaaagugccgacuuaaaauggacaaacuacgauugaaaggagucuccuacucccucugcacagcagccuuuacauuuaccaaaauaccggccgagacccugcacgggacuguaacaguugagguacaauacgccgggaccgacggcccaugcaaaguaccagcccaaauggcaguagacaugcagacccuaacccccguagggcgccugauaaccgccaauccagucaucacagaaucaacggaaaacucaaaaaugaugcuagaacuagaucccccauucggcgacagcuacauagucauaggagucggagaaaagaaaauaacccaccacuggcacaggucaggcucaacaaucggaaaagcauucgaagccacgguacgaggcgcgaaaagaauggcgguccucggcgacacugcaugggacuucggauccguaggcggcgcccucaacucacucggaaaaggaauccaccaaaucuucggcgccgcauucaaaucacuguucggcgggauguccugguucagccaaauacucaucggaacgcuacuaauguggcuaggccuaaacaccaagaacgggagcaucucccugaugugccucgcccuaggaggaguacugauauuccugagcacagccguaagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5028 - RNA, 2287 nt, Artificial Sequence
  ZIKV prME variant mRNA Design 1 opt
gggagaaagcuuaccaugaccuccgucggcaucguaggacuccuccuaacaaccgccauggcagccgcaguuacacgacgaggaagcgccuacuacauguaccuagacagaaacgacgccggagaagccauauccuucccgacgaccuuaggcaugaacaaaugcuacauacaaauaauggaccuaggacacaugugcgacgcaacgaugucauaugaaugccccaugcucgacgaaggaguggaaccugacgacguagacugcuggugcaacacgacaucaaccuggguaguauacggaaccugccaccacaagaaaggcgaagcccgacguucccggcgagccguaacccuccccagccacuccacacgcaaacuacagacacgaucacaaaccuggcuagagucacgagaauacacaaaacaccugauacgcguagagaacuggaucuuccgcaaccccggauucgcacuagccgccgcugccaucgcauggcuacuaggcagcucgaccucacaaaaaguaauauaccucguaaugauccuccuaaucgccccagccuacuccauacgcugcaucggggucucaaaccgcgacuuugucgaaggcauguccggaggaaccugggucgacauaguacucgaacacggcggcuguguaaccguaauggcacaagacaagccuacaguagacaucgagcuagucacaacaacaguaucaaacauggccgaaguacgcuccuacugcuacgaagcaagcauaagcgacauggcaagcgacagccggugccccacacaaggcgaagccuaucuugacaaacagagcgacacacaauacgucugcaaaaggacccucguagacagaggcuggggcaacggcugcggacuauucggaaaagggucacucgucacaugcgcaaaauucgccugcaguaagaagaugaccgggaaaagcauccaacccgaaaaccuagaauaccguaucaugcucagcguacacggcucacaacacuccggcaugauugucaaugacaccggucacgaaacagacgagaaccgcgcaaaaguggaaauaacccccaacucgcccagggccgaagcgacacucggaggauucggaucccuuggccuagacugcgaacccaggacaggacucgacuucucagaccucuacuaccuuaccaugaacaacaaacacuggcucguacacaaagaaugguuucacgacaucccccuaccauggcacgcgggagccgacacaggcacaccacacuggaacaacaaagaagcccuagucgaauuuaaggacgcacacgcaaaaagacaaaccguaguuguccuaggaucacaagaaggcgcaguacacacggcccucgccggagcccucgaagccgaaauggacggcgccaaaggccgacuaagcagcggccaccucaaaugccgccugaaaauggacaaacuccgacuaaaaggugucaguuauucccuaugcacagccgccuuuaccuucacaaaaauacccgcagaaacccuccacggcaccgucaccgucgagguccaauacgccggcacggacggccccugcaagguacccgcacaaauggccguggacaugcaaacccugacccccgugggcagacucauaacagcaaacccagucauaacagaaagcacagaaaacuccaaaaugaugcucgaacuagacccgcccuucggggacucauacauaguaauaggcguaggagagaagaaaaucacccaccacuggcaccgaucgggaucuaccaucggcaaagcauucgaagccaccgugcgaggcgccaaacgaauggcaguccucggcgacaccgcaugggacuuuggcucugucggaggagcccuaaacagccucggcaaaggcauccaccaaaucuucggugcagcguucaaaagccucuucggcggcauguccugguucagccaaauccugaucgggacccuacucauguggcuaggccucaauaccaaaaacggauccaucagccuaaugugccuggcccuaggcggaguccugaucuuccucucaacagcagucagcgcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5029 - RNA, 2299 nt, Artificial Sequence
  ZIKV prME variant mRNA Design 1 opt
gggagaaagcuuaccaugcgaggcgcggacacgucagucggcauagucggucuacuacuuacaaccgccauggcagccgccguuacacgccggggauccgccuacuacauguaccucgaccgcaacgacgccggcgaagcaaucucguucccaaccacacuaggcaugaacaaaugcuacauccaaauuauggaccuaggacacaugugcgacgccaccaugagcuacgagugcccaaugcuagacgaaggaguggagccagacgacguggacugcuggugcaacacuacaucgaccugggucgucuacgggaccugccaccacaagaaaggagaagcacgaaggucaagacgagcuguaacacuaccaagccacuccacaaggaaauuacagacccgaagccaaacauggcucgaauccagggaauacaccaaacaucucauucgcguagaaaacuggauauuccgcaacccaggcuucgcacuagcggcggccgcgauagcuuggcuccucgggagcuccaccucgcaaaaaguaaucuaccuagucaugauccuacucauagcucccgcguacagcaucagaugcaucggcguaagcaaccgcgacuucgucgaaggcaugagcggcggcaccuggguagacauaguacucgaacacgggggcugugucaccguaauggcacaagacaaaccaacgguggauaucgagcuagucacaacgaccgucuccaacauggccgaaguaagaagcuauugcuacgaggcauccauaagcgacauggcaagcgacucgcgcugcccaacgcaaggugaagcauaccuagacaaacaaagcgacacacaauacguaugcaaacgcacccucgucgacagaggguggggcaauggaugcggacucuucggcaaaggcucccucgucacaugcgcaaaauucgccugcuccaaaaagaugacaggcaaaucaauccaacccgaaaaccuagaguaccgaauaaugcucagcguccacggaagccaacacagcggaaugauagucaacgacacaggacacgaaaccgacgaaaaccgcgcaaaagucgaaaucacaccaaacaguccaagagcggaagcaacacuaggcggauucggaucacuaggacuagauugcgagccacgcacaggacuagacuucagcgaccuauacuaccugacgaugaacaacaaacacuggcucguacacaaagagugguuccacgacaucccccucccauggcacgccggcgccgacaccggcaccccgcauuggaacaacaaagaagcccuaguagaguucaaagacgcacacgcaaagcgccaaaccgucgucguacuaggaagccaagaaggagcgguccacacagcccuagccggcgcccuagaagcugaaauggacggagcaaaaggaagacuaagcagcggucaccucaaaugcagacucaaaauggacaaacuacgccucaaaggcguaucguacucccucugcaccgccgccuucacauucaccaaaauaccagcagagacacuacacggaaccgugacaguggaaguccaauacgccggcaccgauggaccaugcaaaguacccgcacaaauggcaguagacaugcaaacccugacacccgucggcagacuaaucacagccaacccagucauaaccgaaagcaccgagaacagcaagaugaugcucgagcucgacccgccauucggggacagcuacaucgucauaggagugggagaaaagaaaaucacccaccacuggcaccgaagcggcucaacaauaggaaaagcguucgaagcgaccguccgaggagccaaacgcauggcaguacucggugacacagccugggacuucggcucaguaggcggcgcccuaaacucucuaggaaaaggcauacaccaaaucuuuggcgcagccuucaaaucacucuucggcggcaugagcugguucucccagauccuaauaggcacacuacuaauguggcucggacucaacaccaaaaauggcucgaucagccugaugugccucgcacuaggcggcguacugaucuuccuauccacagcgguaagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5030 - RNA, 2323 nt, Artificial Sequence
  ZIKV prME variant mRNA Design 1 opt
gggagaaagcuuaccaugcgcggccuaucgucacggaaaagacggagccacgacgugcuaacagugcaauuccucauacucggcaugcuacuaaugaccggaggcgucacccgccgaggcucagccuacuacauguaccuagacaggaacgacgccggggaagccauaaguuuccccacgacacugggcaugaacaaaugcuauauacaaaucauggaucuaggccacaugugcgacgccaccaugagcuacgaaugcccgaugcuagacgaaggagucgagccagacgacguggacuguuggugcaacacaacauccacauggguagucuacggaacaugccaccauaagaaaggagaagcccgacgcucaaggagagccgugacccucccaagccacucgaccagaaaacuccaaacaagaagccaaacguggcucgaaucgagggaauacacgaagcaccuaauaagagucgaaaacuggauauuccgaaacccaggauucgcacuggccgcggccgccaucgccuggcuacucggaagcagcacgagccaaaaaguaauuuaucuuguaaugaucuugcugauagccccggccuacagcauccgaugcaucggcguuucgaauagagacuucguagaaggcaugagcggcgguaccuggguagauaucguccucgaacacgggggaugcgugaccguaauggcccaggacaaaccgaccgucgacauagagcuaguaaccacaacagucagcaacauggcagaagucaggaguuacugcuaugaagcaucaauaucagacauggcaagcgacagcagaugcccuacacaaggggaggcauaccucgacaaacaaagugacacccaauacgucuguaaaagaacccuagucgaccgcggaugggggaauggcugcggacuauucggaaaagggagccuagugacaugcgccaaauucgcaugcucaaagaaaaugacaggaaaaagcauccaaccagaaaaccucgaguacagaauaaugcucagcguccacgggucacagcacagcggcaugauaguaaacgacaccggacacgaaaccgacgaaaaccgagccaaaguagaaauaaccccuaauagccccagagcugaggcaacccuaggaggcuucggcagcuugggacucgacugcgaaccccgaacgggacucgacuucuccgaccuauacuaccucaccaugaacaacaaacacuggcucgugcacaaagaaugguuccacgacaucccccugcccuggcacgccggcgccgacacaggaacgccucacuggaacaacaaggaagcccuuguagaguucaaagacgcgcacgcaaaacgccaaacgguggucgugcucggaagucaagaaggagccgugcacacggcacuagccggcgcgcucgaagccgaaauggacggagcaaaggggcgacugagcagcggacaccugaaaugccggcugaaaauggacaaacugagacuaaaaggagucagcuacagccuaugcaccgccgcauucacauucacaaaaauaccggccgaaacacuacacgguacagucacgguagaaguccaauacgcggggacagacggacccugcaaagucccagcgcaaauggcgguagauaugcagacacucacacccguggguagauuaauaacagcaaaccccgucaucacagaaagcacggaaaacagcaaaaugaugcuagaacuagacccacccuucggagauucauacauagucauaggcguaggcgaaaagaaaauaacccaccacuggcaccgcagcggcagcacaaucggaaaagcauucgaagcaacggugaggggagccaaacgaauggcgguccucggagauacagccugggacuucggaagugucgggggugcacugaacagccuaggcaaaggcauacaccaaaucuucggagcagcguucaaaagccucuucgggggaaugagcugguucucccaaauauugauaggaacucuacucauguggcucgggcuaaacacuaaaaauggcagcaucagccucaugugccuggcccucggaggcguccucauauuccuaagcacagccgucagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5031 - RNA, 2323 nt, Artificial Sequence
  ZIKV prME variant mRNA Design 1 opt
gggagaaagcuuaccaugcgaggccuuagcucccgcaaacgacgcagccacgacguacuaaccguccaauuccuaauacuaggcaugcuccucaugacaggcgccguaacaagacgggguuccgcauacuacauguaccucgacaggaacgacgcgggagaagccauuuccuucccaaccacacucggcaugaacaaaugcuacauacaaauaauggaucucggacacaugugcgacgccaccaugucauacgaaugcccaaugcuagacgaaggaguggaacccgacgacguagacugcuggugcaacaccacauccaccuggguagucuacggaacgugccaccacaagaaaggagaagcacggcgaagccgacgagccguaacccuccccucccacagcacucgcaaacuccaaacacgaucacaaacauggcuagaaucccgcgaauacaccaaacaccuaauacgcgucgaaaacuggaucuuucgaaacccaggcuucgcccucgcagcagccgcgauagcauggcuucuuggaagcagcacaagucaaaaaguaaucuacuuaguaaugauccugcuuauagcgccugcauauucgauacggugcaucgggguaagcaaccgcgacuucgucgaaggaaugucaggaggcaccuggguagacauuguacucgaacacggaggaugcguaaccguaauggcccaagacaaaccuacagucgacauagagcucguaacgaccacaguaagcaacauggcagagguccgaucauacugcuacgaagccucaauaagugacauggccucagacucacgcugcccaacccaaggcgaggccuaccuagacaagcaauccgacacacaguacgucugcaaacgcacacucgucgacagaggguggggcaacgguugcggccuuuucggcaaaggaucacucguaacaugcgcaaaauucgccugcuccaagaaaaugacuggaaaaagcauacaaccagaaaaccuagaguacagaauaaugcuauccguacacgggagccagcacucaggaaugaucgucaacgacacgggacacgaaaccgacgaaaaccgcgcaaaaguagaaauaacacccaacucaccccgagcagaagcgacccuaggaggauucggaucccucggacuagacugugaacccagaacaggccucgacuucagcgaccucuacuaccucaccaugaacaacaaacacuggcuuguccacaaagagugguuccacgacaucccccuacccuggcacgccggagcagacaccggcaccccacacuggaacaacaaagaagcccucgucgaguucaaagacgcgcacgcaaaacgacaaaccgucgucguucuuggaucccaggaaggagccguccauacagcacuagcaggcgcccuggaagccgaaauggacggcgccaaggggcggcuaucaucaggccaccuaaaaugucgccuaaagauggacaaacuccgacuaaaaggggucucauacucucuaugcaccgcggcauucaccuucaccaagauccccgcagaaacccuacacggaaccgucacaguagaaguacaauacgccggcacagacggccccugcaaggucccagcccaaauggccguagacaugcaaacacugaccccaguaggacgacuaauaaccgcgaaccccguaauaaccgaaucgaccgaaaacucaaaaaugaugcucgaacuagacccaccguuuggcgacagcuacaucgucaucggcgucggagagaaaaagauaacccaccacuggcacagguccggaagcaccaucgguaaggcuuucgaagcaaccguccgcggagccaaacgcauggccguccuaggagacacagcaugggauuucggcagcgucggcggagcccugaacagccucggaaaaggaauacaccaaauauucggagccgcguucaaaagccuauucgggggcauguccugguucucacaaauccuaaucggcacacuacugauguggcucggccucaacaccaaaaacgggagcauuagccucaugugucuagcucuaggcggcguacuaaucuuccuauccacagcagugagcgcggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5032 - RNA, 2329 nt, Artificial Sequence
  ZIKV prME variant mRNA Design 1 opt
gggagaaagcuuaccaugcgcaucauaaacgccagaaaagaaaagaaacgaaggggagccgacacaucaguaggcaucgucggacuacucuugaccaccgcaauggccgcggaagucaccagaaggggcucagcauacuacauguaccuagaccguaacgacgccggagaagcaaucuccuuccccaccacccuuggaaugaacaaaugcuacauacaaauaauggaucuaggccauaugugcgacgccaccauguccuacgaaugccccaugcucgacgaaggaguagagcccgacgacguggacuguugguguaauaccaccagcacaugggucgucuaugggaccugccaccacaagaaaggcgaagcacgaagaagucgacgagcaguaacacuaccgagccacagcacccgaaaacuacaaacaagaagucaaacauggcuagaaagccgagaauacacgaaacaccuaauaagaguagagaacuggauauucagaaacccaggguucgcccucgccgccgcggccaucgcauggcugcuaggcuccagcacaucgcaaaaaguaauauaccuagucaugauucuacuaaucgcacccgcauacagcauccgcugcauaggcgucucgaaccgcgacuucgucgagggcaugucaggaggcacauggguggacaucgucuuagaacacgguggaugcgucaccgucauggcccaagacaaacccaccguagacaucgagcugguaaccaccaccguauccaacauggccgaagugcgguccuacugcuacgaagccucaauaagcgacauggccuccgacagcagaugcccaacccaaggggaggcguaucucgacaaacaaagcgacacccaauacgucugcaaacgaacacucguagaccgcggguggggaaacggcugcggacucuucggaaaaggcagccucguaaccugugccaaauucgcaugcucgaagaaaaugaccggaaaauccauacaaccagagaacuuagaauaccgcaucaugcuaagcguacauggcagccaacacagcggcaugauaguaaacgacacaggccaugaaacagacgaaaaccgagcaaaagucgaaaucacccccaacagcccgagagcagaagccacacuaggaggauucggcagccuaggccuggacugcgaaccaaggacaggccucgacuucagcgaccucuacuaccucaccaugaacaacaagcacuggcuaguacacaaagaaugguuccacgacauaccacuccccuggcacgcaggcgccgacacagggacaccccauuggaauaacaaagaagcacugguagaguucaaagacgcccacgccaagagacaaaccguaguaguacuaggcucccaggaaggggcaguccacacagcacuagcgggagcacuggaagcagaaauggacggcgccaaagggcgacuaagcagcggccaccugaaaugcagacuuaaaauggauaaacuacgacuaaagggcgucagcuacagccucugcaccgcugccuucacauucacgaaaauccccgccgaaaccuuacacggcacggucacagucgaaguacaauacgccggaaccgacgguccaugcaaaguacccgcacaaauggccgucgacaugcagacacuaacacccgucggacggcuaauaacagccaaccccguuaucacagaaucgaccgaaaauucaaaaaugaugcucgaacuagacccaccguuuggagacuccuacaucguaaucggcgucggagaaaagaaaaucacacaccacuggcaccgcagcggcuccacgauagggaaagcauucgaggccaccguccgaggagcaaaaagaauggccguccucggcgacacagcaugggacuucggcagcgucggaggcgcgcucaacagucucggaaaaggcauccaccaaauauucggcgcagcauucaaaagccuuuucggcggcaugagcugguuuucacaaauccuaauaggaacccuccucauguggcucggccuaaacaccaaaaacgggucaauaagccuaaugugccuggcccucggcgggguccuaauauuccucuccacggcagucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5033 - RNA, 2323 nt, Artificial Sequence
  ZIKV prME variant mRNA Design 1 opt
gggagaaagcuuaccaugauaaacgcccgaaaagagaaaaagcgccgaggagccgacacauccguagguauagucggccucuuauuaacaacagcaauggcugccgaaguaacaagacgcggcagcgcauauuacauguaccuugaccgaaacgaugcaggggaagcaauaucauuuccaacaacacuuggcaugaacaaaugcuauauccaaaucauggacuugggacacaugugcgacgccacaaugucauacgaaugcccgaugcuagacgaagggguggaaccggacgacguugacugcuggugcaacacaacuucaaccuggguagucuacggaaccugccaccacaagaaaggcgaagcaagaagauccagacgggccgucacacuccccagccacagcacuagaaaacuacaaacccgaagccaaacauggcucgaaagccgcgaauacacaaagcaucugauccgaguggaaaacuggaucuuccgaaaccccggcuucgcccucgccgccgcagccauagcauggcuccugggauccuccacgucacaaaaagugauauaccuaguaaugauccugcucauagccccggccuacuccauacgcugcauaggcguaagcaaccgagacuucguagagggaaugucagggggcaccugggucgacaucguccuagaacacgggggcugcgucacagucauggcgcaagacaagcccacagucgacaucgagcucgucacaacaaccguaucaaacauggcagagguaagguccuacugcuacgaagcgucaaucucagacauggccagcgacucccguugccccacacaaggcgaggccuaccuagacaaacaauccgacacacaauacguaugcaaacgaacacucguagaccggggcuggggaaacggcugcggacucuucggcaaaggcagccucgucacaugcgcgaaauucgccugcucaaagaaaaugaccggaaaaagcauccaacccgagaaccuagaauaccgaauaaugcuaagcguacacgggucccaacacuccggaaugaucgucaacgacaccggacacgaaaccgacgaaaacagagcuaaaguagaaaucacgccaaacucgccacgcgcagaagccacgcucggaggauucggaucacuagggcuagacugcgagccacgcaccgggcuagacuucuccgaccuauacuaccuaaccaugaacaacaaacacuggcuuguucacaaagaaugguuccaugacaucccccuccccuggcacgcaggagccgacacaggaaccccacacuggaacaacaaagaagcccuaguagaguucaaagacgcacaugcaaaacgccagaccgucgucguacuaggaucccaagaaggagcuguccauaccgcacucgccggcgcccucgaagccgaaauggacggagccaaagggcgccuaagcuccggacaccucaaaugccgacuaaaaauggacaaacuaagacugaaaggcgucagcuacagccuaugcacagccgcauucacauucaccaaaauuccagcagaaacgcuccacggaacagucaccguagaaguacaauacgccggcacagacggccccugcaaagugccagcccaaauggcgguagacaugcaaacacucacaccagucggccgccuaauaacggcuaacccaguaaucaccgaaagcaccgaaaauagcaaaaugaugcuugaacucgacccgcccuucggagacagcuacaucgucaucggcgucggggaaaagaaaauaacacaccacuggcaccgaagcggguccacaaucggcaaagccuucgaagcaaccguaaggggcgcaaaacgcauggccguacucggagacacggccugggacuucgguuccgucggaggcgcacuaaacagccugggcaaaggcauccaucaaaucuucggagcagcauucaaaucacuuuuugggggaaugagcugguucucccaaauccugaucggcaccuuacuaauguggcugggccuuaacaccaaaaauggcagcaucucgcucaugugccucgcacucggaggaguccuaaucuuccugagcacagccguauccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5034 - RNA, 2326 nt, Artificial Sequence
  ZIKV prME variant mRNA Design 1 opt
gggagaaagcuuaccaugauaaucaacgcaagaaaggaaaagaaacgccgcggugccgacacaucaguaggcauagucggccuccuccucacgacagcuauggccgcagaaguaacacgacgcggaagcgcguacuacauguaccucgaccgcaacgacgccggagaagcgaucuccuucccgaccacacucggcaugaacaaaugcuacauccaaaucauggaucucggacacaugugcgacgccaccauguccuacgagugcccaaugcuagacgaaggagucgaacccgacgacguagauugcuggugcaacacgaccuccacaugggucguuuacggaaccugucaccacaagaagggcgaagcccgacgaagccgcagagcagucacccuacccagccacuccacucgcaaacuccagacacgaagccaaacauggcucgagagccgagaguacacaaaacaccucauaaggguagaaaacuggaucuuccgaaauccaggcuucgcccuagccgcagccgccaucgcguggcuucuaggcucaagcacgucacaaaaggucaucuaccucgucaugauccuacuaaucgcuccagccuauucaauccggugcauagguguaagcaaccgagacuucguagaaggcaugucaggaggaacauggguagacaucguccuggaacauggcggaugcguaaccgucauggcccaagacaaacccacaguagacaucgaacucgugaccaccaccguaagcaacauggcagaaguccgaagcuacugcuacgaggcuucaaucagcgacauggcaucagacagcagaugccccacacaaggcgaagccuaccuagacaagcagucagacacccaauauguaugcaaacgcacccuagucgauaggggauggggaaacggaugcggacucuucgguaaaggcagucucgugaccugcgcgaaauucgcgugcuccaagaaaaugacgggcaaaagcauucaacccgaaaaccuagaauacagaaucaugcuaucaguccacggcucccaacacuccggcaugauugucaacgacaccggccacgaaaccgacgaaaaccgagcaaaagucgaaaucacacccaacagcccgcgcgccgaagccacacucggcggcuucggcagccugggccucgacugugaaccccgcacaggacuagacuucagcgaccucuacuaccugacaaugaacaacaaacacuggcucguccacaaagaaugguuccacgacauuccccuccccuggcacgccggcgcagauaccggaaccccacacuggaacaauaaagaagcacucguagaguucaaggacgcgcacgcaaaacggcaaacagucgugguccugggcucgcaagaaggcgcaguccacacagcccucgccggcgcccuagaagccgaaauggacggagcaaaagguagacucagcucaggacaccuaaaaugcagacucaagauggacaaauuacgccucaaaggcguaucuuacucccuaugcaccgccgcauucaccuuuaccaaaaucccggcagaaacgcuccauggaacagucaccgucgagguccaauacgccggaaccgauggaccuugcaaaguccccgcccaaauggcgguugacaugcagacccugacccccgucggccgacucaucaccgccaacccagucaucacugaaagcacagaaaacuccaaaaugaugcucgaacucgacccacccuucggcgacaguuacauugucaucggcgucggggaaaagaagaucacacaccauuggcaccgguccggaagcacgauuggaaaggccuucgaagcaaccgucagaggagccaaaagaauggcgguacucggcgacaccgcaugggacuuuggcuccgucggcggagcacuuaacucacucggaaaaggcauacaccaaauauucggugcugccuucaaaucacucuucggcggcaugagcugguucucacagauacuaaucggaacacuacuaauguggcuaggccucaacaccaaaaacggaagcauaucacuuaugugccuagcccucggcggaguacuaaucuucuuguccacagcagucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5035 - RNA, 2320 nt, Artificial Sequence
  ZIKV prME variant mRNA Design 1 opt
gggagaaagcuuaccaugaacgccagaaaagaaaagaaacgaagaggcgccgacaccagcguuggaaucgucggacuacuacuaaccaccgcgauggcagccgaagucacgagaaggggaagcgccuacuacauguaccuagacagaaacgacgcaggcgaggcaauaaguuuccccacaacgcuaggaaugaauaaauguuacauacaaauaauggaucucggacacaugugcgacgcaacaaugagcuacgaaugcccaaugcuagacgaaggagucgaaccagacgauguggacugcuggugcaacacaacuagcacaugggucgucuacggcacaugccaccacaagaaaggagaagcacgaaggagucgcagagccgucacgcuacccagccacucaacgagaaaacuccagaccaggagccaaacguggcuagagagcagagaauacacaaaacaccuaauaagagucgaaaacuggaucuuccgaaacccaggcuucgcccucgccgccgcagccauagccuggcuccuagguucuaguaccagccaaaaaguaauauaccuagugaugauccuacugauagcacccgcauacuccauccguugcauaggagucagcaaccgcgacuucguagaaggaaugagcggaggaaccugggucgauaucguacuagaacacggcggcugcgucacagucauggcccaagacaaaccaaccgucgacauagaacucgugacaacaacaguuagcaacauggcggaagugcgaagcuacugcuaugaagccuccauaucagacauggcaucggacagccgauguccaacacaaggagaagccuaccuagacaagcaauccgacacacaauacguaugcaaaagaacccuagucgaucgaggcuggggcaacgggugcggccuuuucggaaaaggaagccuggucacaugcgccaaauucgcgugcagcaagaaaaugacaggcaaaucaauccaaccagaaaaccucgaauaucgaaucaugcucucgguacacggcagccaacacuccggaaugaucguaaacgacacaggucacgagacagacgaaaacagagcaaaagucgaaaucacgcccaacagcccaagagccgaagcaacacucggcggguucgggagccuaggacuagacugcgaaccccgaacaggccucgacuucucggaccucuacuaucuuaccaugaacaacaaacacuggcuaguccacaaagaaugguuccacgacaucccccuccccuggcacgcaggggcagacaccggaacgccgcauuggaacaauaaagaggcucuagucgaguucaaggacgcacacgcgaaaagacaaaccgucgucguauuaggcucacaagagggcgccguccacacagcgcucgcaggggcacuagaagccgagauggacggcgcgaaaggaaggcuaucaucaggucaccucaaaugccggcuuaagauggacaaacugagacuaaaagggguauccuauucacucugcacagcagcauucacauucacaaaaauccccgcagaaacacugcacggaacaguaaccguagaaguccaauacgcaggcaccgacggcccaugcaaaguaccugcccaaauggccguagacaugcagacccuaacgcccgucggccggcucaucacggccaacccgguaauaacugaaucaacagaaaacucuaaaaugaugcuggaacuggacccacccuucggcgacaguuacauagucaucggugucggugaaaagaaaaucacccaccacuggcacagaagcggaagcacuauaggcaaagcguucgaagccacaguaagaggcgcaaaaaggauggcaguacuaggagacaccgccugggacuucggcucaguaggaggagcacuaaacucgcucggcaagggaauccaccaaauauucggagccgcauucaagagccuauucggcggaaugagcugguucucacaaauccuaaucggaacgcugcuaauguggcucggccuaaacacaaagaacggcagcaucagccuaaugugccucgcccucgggggcguccuuauauucuugagcacagcaguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5036 - RNA, 2317 nt, Artificial Sequence
  ZIKV prME variant mRNA Design 1 opt
gggagaaagcuuaccauggccaggaaagagaaaaagagaagaggcgcggacacaucaguaggaauagucggacuacugcuaacaaccgccauggcagcagaaguaacccgaagaggcucagccuacuacauguaccucgaccgaaacgacgccggagaagccauaucauuccccaccacccucggaaugaacaaaugcuacauccagaucauggaccucggccacaugugcgaugcaaccaugagcuacgaaugcccaaugcucgacgaaggcguagaaccagacgacguagacugcuggugcaacacaaccaguacguggguagucuauggcacaugccaccacaagaaaggcgaagcacgcagaagccgccgcgcagucacucucccaucucacagcaccagaaaacuccagacaaggagccagaccuggcuggaaucccgagaauacaccaaacaccuaauaagggucgaaaacuggauuuuccgcaacccaggcuucgcacucgcagccgcagccauagccuggcuacugggcagcagcacaagccaaaaagugaucuaucucgucaugauacuccugauugccccagcuuacuccaucagaugcaucggcguaagcaaccgagacuucgucgaggggaugucgggaggaaccuggguugacaucguacucgaacacggcggaugcguaaccguaauggcucaagacaaacccaccguugacauagaacuggugacaaccacaguauccaacauggcagaggugagaucauacugcuacgaggcuucaaucucugacauggccucggacagccgcugccccacacagggggaagcguaccucgacaaacaaucagacacacaguacgucugcaaacgaacccucguagaccgcggauggggcaacgggugcgggcuauucggcaaaggaucacucgucacaugcgcaaaauucgcuugcucgaagaaaaugacaggcaaaagcauacaaccagagaaccucgaauacagaauaaugcugucaguacacggcucacaacacagcggaaugauugucaacgacacaggacacgagaccgacgaaaacagggccaaaguagaaauaacccccaacagcccccgagccgaggcaacacuuggaggauucggcucccuaggauuagacugcgaaccgcgcaccggacuggacuuuagcgaccuauacuaccucacaaugaacaacaaacacuggcuaguccacaaagagugguuccacgacauaccccucccauggcaugccggagcagacacaggaaccccacacuggaacaacaaagaagcgcugguagaguucaaagacgcccacgcaaaacgccaaacagucgugguccucggcagccaagaaggcgccguccacaccgcacucgccggcgcacuagaagcagaaauggacggcgcgaaaggccggcucagcuccgggcaccuaaaauguagacuaaaaauggauaagcuacgccuaaaagggguaucauacagccuaugcaccgccgccuucacauucacaaaaauaccggcagaaacacugcacggaacaguaacagucgaaguacaauacgcaggaaccgauggcccaugcaaaguuccagcccaaauggcagucgacaugcaaacacugaccccggucggaagacuuaucacagcaaaccccgucaucacagaaucaaccgaaaacagcaaaaugaugcucgaacuagacccaccauucggcgacaguuacauagugauaggcguaggagagaagaaaaucacccaucacuggcacagauccgggagcacuauagggaaagccuucgaggccacaguaaggggagccaaacgcauggccguccucggugacacagcaugggacuucggcucaguaggcggcgcccucaacucccucggaaaaggaauccaccaaauauucggggccgcauucaagagccuguucgggggcaugagcugguucucccaaauccuaauaggcacccuccucauguggcuaggccucaauaccaaaaacggaaguaucucacucaugugccuagcacuaggcggcguccucauauuccucagcacagccguuagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5037 - RNA, 2314 nt, Artificial Sequence
  ZIKV prME variant mRNA Design 1 opt
gggagaaagcuuaccaugcgaaaagagaagaaaagacgcggagcagacaccagcgucggaaucgucggccuucuccucacuacagccauggccgccgaagucacgagacgcggauccgcauacuacauguaucuagaccgaaacgacgccggcgaggcaaucucauuccccaccacccucggcaugaauaaaugcuauauccagauaauggaccucggccacaugugcgacgcaacaaugagcuacgaaugccccaugcucgacgagggaguagaacccgaugacguugacugcuggugcaacacaaccucgaccugggucguguacggcacaugccaccacaagaaaggagaagcgagacgcucccgucgagcaguaacccuuccaucccacagcacccggaaacuccaaacacgcucccaaaccuggcucgaaucccgcgaauauacaaaacaucuaauccgaguagaaaacuggaucuuccgcaacccgggauucgcccuggcagcggccgccaucgccuggcuacucgguagcuccaccagccaaaaaguaaucuaccucguuaugauacuacuaaucgccccagcauacucaauacgcugcaucggcguaagcaaccgagacuucgucgaaggaaugucaggcggcaccugggucgacaucguccuagaacacggcggaugcgucaccgucauggcgcaagacaaaccaaccguagacauagagcuaguaacaaccaccguaucaaacauggccgaaguccgaagcuacugcuacgaagcaucgauauccgacauggccuccgacucacgcugccccacccaaggagaagccuaccuagacaaacagucggauacgcaauacgucugcaaacgaacccuagucgaccgaggcuggggaaacggcugcggccucuucggaaaagggucccuaguaaccugcgcaaaauucgcaugcagcaagaaaaugacaggcaaguccauccagcccgaaaaccucgaauaucgaauaaugcucuccguccacggcucacaacacagcggaaugaucgucaacgacaccggacacgaaaccgacgaaaaccgagcaaaagucgagauaaccccaaacucaccucgcgcugaggcaacacucggaggcuucggcucccucggacucgacugcgaaccacgaaccgggcuagacuucagcgaucuauauuaccucaccaugaacaacaaacacuggcuaguccacaaagaaugguuccacgacauaccacuccccuggcacgccggcgcagacaccggcacgccccacuggaacaacaaagaagcccuggucgaguucaaagacgcccacgccaaacgucaaaccgucgugguacucgggucccaagaaggagcaguccacacagcacuugcgggcgcccuggaagccgaaauggacggcgccaaaggacgucucuccagcggacaccuaaagugccgccugaaaauggacaaacuacgacuaaagggagucucauacagcuuaugcaccgccgccuucacauuuaccaaaauacccgcagaaacgcuacacggcaccguaaccgucgaaguacaauacgcgggaacagacggacccugcaaaguaccugcucaaauggccguagacaugcaaacacucacaccagucggaagacuaaucacagcaaaccccguaaucaccgaaagcaccgaaaauuccaaaaugaugcucgaacuagacccaccguuuggagacucuuacaucguaauaggagugggcgaaaagaaaaucacacaucacuggcaccgaucgggaucgaccauagguaaagccuucgaagcaacagugcgaggcgccaaacgaauggcuguacuuggagacaccgcaugggauuuuggcuccguuggaggagcccuuaacagccucggcaaaggcauacaccagauuuucggcgcagccuucaaaucccucuucggcggcauguccugguucucccaaauccucaucggaacccuacucauguggcuaggccucaacacgaaaaacggaucaauaucccucaugugccuagcacugggcgguguacuaauauuccucuccaccgccgucucagcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5038 - RNA, 2311 nt, Artificial Sequence
  ZIKV prME variant mRNA Design 1 opt
gggagaaagcuuaccaugaaagagaaaaagaggagaggcgcggacacguccgucgguauaguaggccuacuucuaacaaccgccauggccgcagaaguaacccgucgaggaagcgccuacuacauguaccucgaccgaaacgacgccggcgaagcgaucagcuuccccaccacccucggcaugaacaaauguuacauccagauaauggaccucggccacaugugcgacgccacgaugucauacgaaugccccaugcuugacgaaggcguugaaccagacgacgucgacugcuggugcaacacuacaagcaccuggguggucuacggcacuugccaccacaaaaagggagaagcacgccgcagccgucgagccguaacccuucccucacacagcacccgaaagcuccaaacccgcucccaaaccuggcuagaaucucgagaauacaccaaacaccucauuagagucgaaaacuggauauuccgcaauccaggcuucgcccuagcagcagccgcaaucgccuggcuucucggauccucaacaucacagaaagucauauaccucguuaugauacuccuaaucgccccagccuacagcaucagaugcaucggcgucagcaaccgagacuucguagaaggcaugagcggaggaacauggguagacaucguccucgaacacggaggaugcgucaccguaauggcccaagacaaacccacaguugacauugagcuagucacaaccaccgugagcaacauggccgaagugcgcagcuacugcuacgaagccuccauaucagacauggcaucagacagccgcugcccuacacagggagaagcauaccuggacaaacaguccgacacacaauacgucugcaaacgaacccucguagaccgaggcuggggaaacggaugcggacuauucggcaaaggcucccucgucacaugcgcaaaguucgccugcagcaagaaaaugaccggcaaaucuauccagcccgagaaccucgaauacagaauaaugcucuccguacacggaucccaacacagcggcaugaucgucaacgacacaggacacgaaacugacgaaaaucgcgcgaaagucgaaaucacacccaacuccccucgagcggaagcuacccugggcggcuucggcagccuaggccucgauugcgaaccacgaacaggcuuagacuucuccgaccucuacuaccuaacgaugaacaauaaacacuggcuaguccacaaagaaugguuccacgacauaccguuaccguggcacgccggggccgauaccggaacaccacauuggaacaacaaagaagcacugguagaguucaaagacgcccacgcaaaacgccaaaccgucgucguacucgggucccaagaaggcgcaguccacacagcccucgcaggagcccucgaagccgaaauggacggcgcaaaaggccgccucagcaguggucaccuaaaaugcagacuaaaaauggacaaacuccgacuaaaaggcgucucguacucccuguguaccgcagcuuucacuuucaccaagauccccgcagaaacccuccacggcaccgucaccguagaagugcaauacgcagggaccgauggccccuguaaaguaccggcccaaauggcagucgacaugcagacccugacacccgugggccggcucaucacagcaaaccccguaauaacagaauccaccgaaaacuccaagaugaugcuagagcuagaucccccauucggcgacagcuacauagucaucggaguaggagaaaagaaaaucacacaccacuggcaccgguccggcuccaccauaggcaaagcauuugaagcuacaguccgcggcgccaaacgcauggcaguacuuggcgacaccgccugggacuucggcuccguaggaggggcgcucaacagccuagggaaaggaauccaccaaaucuuuggagccgcauucaaaucccuauucggcggcauguccugguucucucaaauccugaucggcacccuacucauguggcuaggccucaacaccaaaaacggcuccaucucccuaaugugccuggcacucggaggaguacucaucuuccuauccacagccgucuccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5039 - RNA, 2308 nt, Artificial Sequence
  ZIKV prME variant mRNA Design 1 opt
gggagaaagcuuaccauggagaagaaaagaagaggagcagacaccagcguaggcaucguaggccuccuacucacaaccgcaauggccgccgaaguaacccgccggggcuccgcauacuacauguaccuagaccgcaaugaugccggcgaagcaauaucguuccccaccacccucggcaugaacaaaugcuacauacaaaucauggaccuaggacacaugugcgacgccaccauguccuacgaaugccccaugcuagacgaagggguugaacccgaugacgucgacugcuggugcaauacaacgagcaccugggugguuuacggaacgugccaccacaagaaaggggaggcccgccgcucccgcagagccguaacccuccccucacacagcaccagaaaacuacagacacgaagccagacauggcucgaaucacgagaauacaccaagcaccucauccgcguagaaaacuggauauuccgcaaccccggcuucgcccuagccgcagccgccaucgccuggcuccuuggcuccucaacaagccaaaaagucauauaccucgucaugauucuacucaucgcgcccgccuacuccauccguugcaucggagucuccaacagagacuucgucgaaggcaugucaggaggcaccuggguugacaucguccuugaacacggggguugcguaacggugauggcccaggacaaacccacaguagacauagaacuugugaccacaacuguauccaacauggcggaaguccgcucauacugcuacgaagccagcaucucggacauggccuccgacucccgaugcccaacacaaggcgaagcauaccucgacaaacaauccgacacccaauacgucugcaaacggacacucgucgaccgcggauggggaaacggcuguggucuauucggcaaaggaucccuagugaccugcgcaaaauuugcuugcucaaagaaaaugacgggaaaaucaauccagcccgaaaaccucgaauacagaaucaugcuuuccguccacggcagccaacacagcggaaugauagucaacgacaccggccaugaaaccgacgaaaaccgggccaaaguagaaaucaccccaaacucaccccgcgcagaagccacccucggaggguucggaagccucggacucgacugcgaaccacgcacuggacuagacuucucagaccuguacuaucucacgaugaacaauaaacauuggcuaguacacaaagagugguuccacgauauaccacuaccauggcacgccggagcagacacaggcacaccccacuggaacaacaaagaagcccucguagaguucaaagacgcacacgccaaacgucaaaccgucguaguacucgguucacaagagggcgcuguacacaccgcacuagccggcgcccucgaagccgaaauggauggagccaaagggcgccuauccucaggccaccuaaaaugccgacucaaaauggacaaacuucgccucaaagggguaucauacucccuaugcacagccgccuucaccuucacaaagauacccgccgaaacauuacacggcaccgucacagucgagguccaauacgccggcaccgacggacccugcaaagucccggcacagauggcaguagacaugcaaacccucacacccgucggccgccuaauaacagcaaaccccgucaucaccgaaucaaccgaaaacagcaaaaugaugcuggaacucgacccacccuucggcgacuccuacaucguaaucggcguaggcgaaaagaaaauaacccaucacuggcacagguccgguagcaccaucggaaaagcauucgaagcaaccguccgaggcgccaaacggauggcuguacuaggagacacugccugggacuucggcuccguuggcggcgcccuaaacucgcuaggcaaaggaauccaccaaaucuucggcgccgccuuuaaaagccuauucggaggaaugagcugguucucacaaauccucaucggaacacuacuaauguggcugggacugaacaccaaaaacggaagcauaucacuuaugugccucgcacuagguggcguucuuaucuuccucagcacagcgguaucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5040 - RNA, 2305 nt, Artificial Sequence
  ZIKV prME variant mRNA Design 1 opt
gggagaaagcuuaccaugaagaaacggcgaggcgccgacacaagcgucggcaucguaggccuacuccuaaccaccgcuauggcagccgaaguaacacgccgaggaagcgcauacuauauguaccuagaucgcaacgacgcaggcgaggccaucagcuuccccaccacauuaggcaugaauaaaugcuacauccaaauaauggaucuaggccacaugugcgaugccacaaugaguuacgaaugcccaaugcucgacgagggagucgaacccgacgacguagacugcuggugcaacaccacuucaacaugggucguauacggaaccugccaccacaagaaaggcgaagcaaggagaucaaggagagcugucacgcuccccucacacagcacccgcaaacuacaaacacggucccaaaccuggcuggaaagccgagaguauacaaaacaccuaauccgcgucgaaaauuggauauucagaaaccccggcuucgcgcucgcagcagccgcaauagcauggcuacucggcucaagcacuucacaaaaagucaucuaucuagucaugauccuucucaucgcaccagcauacaguauacgcugcauagggguaagcaaccgggacuucguugaaggaauguccgggggcacguggguagacauaguacuagaacacggaggaugcguaacgguaauggcccaagacaaacccacaguggacaucgagcuaguaacgacaacagucagcaacauggccgagguacggucauacugcuacgaggcaagcauaucagacauggcauccgacucaaggugccccacacagggcgaggccuaccucgacaagcaaagcgacacacaauacgucugcaaacggacccucguagauagaggcuggggcaacggaugcggccucuucggaaaagggagccuaguaacaugcgcaaaauucgccugcagcaagaaaaugaccggaaaaagcauacaaccagaaaaccuugaauaccgcauaaugcuaagcguacacggcagccaacacagcgguaugaucguaaacgacacaggacacgaaaccgacgaaaauagagcaaaaguagaaauaacaccgaacuccccucgggcagaagccacacucgggggauucggaagccuaggccuagacugcgagcccagaaccggacuggacuucagcgaccucuacuaccuaacaaugaacaacaagcacuggcuaguacacaaagaaugguuccacgacauaccucucccauggcacgcaggggcagacacaggcacaccccacuggaacaauaaagaagcccuaguggaguucaaagacgcccacgcaaaaagacaaaccguaguaguccucggaagccaagaaggcgccguccacaccgcgcuagccggggcgcuggaagcggaaauggacggcgccaaaggacgacuaagcagcggccaccuaaaaugccgacuaaaaauggacaaacuaaggcucaaaggcguauccuacucacucugcacagccgccuucaccuucacaaaaauaccagcagagacgcuccacggcacagugacgguggaaguccaauaugccggcacagacggaccaugcaaggugccagcacaaauggcggucgacaugcaaacacuaacacccguaggccgccuaauaaccgccaaccccguaaucaccgaaagcacggaaaauucgaaaaugaugcuagagcucgacccaccguucggagacucauacaucgucauaggagugggcgagaaaaagauaacacaccacuggcaccgaagcggcuccacaaucggaaaagcauucgaagccacaguaagaggggccaagagaauggccguacucggagauacagcaugggauuucgggucaguaggcggagcccuaaacagccuaggcaaaggcauccaccagaucuucggagcagcauucaaaagucucuuuggaggaauguccugguucucccaaauacugaucggcacacuacugauguggcugggacuaaacaccaaaaacgggagcaucucacucaugugucuggcacugggcggaguacucaucuuccuaagcacagccguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5041 - RNA, 2302 nt, Artificial Sequence
  ZIKV prME variant mRNA Design 1 opt
gggagaaagcuuaccaugaaaagacgcggcgcggacaccuccgucggcauagucggucuucugcucacaacagcaauggccgcagaggucacacgaagaggcagcgccuacuacauguaccucgaccgaaacgacgcaggcgaagcaaucucauuccccacaacccuaggcaugaacaaaugcuacauccagauaauggaccuaggccacaugugcgacgccacaauguccuacgaaugcccuauguuagacgaaggaguugaaccagacgacguagacugcuggugcaacacaacaucaacgugggugguguauggcacaugccaucacaagaaaggagaagccagacgcagcagacgagcagucacccuacccagccacucaacacgaaaacuccaaacacggucacagacauggcucgaaagccgcgaauacacgaaacaccuaauccgggucgagaauuggaucuuccgcaauccaggauucgcccucgcagccgcagccaucgccuggcuacuaggaagcuccaccucacaaaaagucaucuaccucgucaugauacuccuaauagcaccagccuacuccaucagaugcauaggcgucagcaaccgcgacuucguagaaggaaugaguggcggcaccugggucgacaucguccuagaacacggcggaugcguaaccgugauggcgcaggacaaacccaccguggacauagagcuagucaccaccaccgucucgaacauggcagaaguacgauccuacugcuacgaagccagcauaagcgacauggcaagcgacagucgcugccccacccaaggagaagccuaccuagauaaacaaagcgacacccaauacgucuguaaacgaacccuagucgaccgcggauggggcaacggcuguggacucuucgggaaaggcucacuggugacaugcgccaaauucgcgugcucuaagaaaaugacagggaaaucuauccaacccgaaaaccuagaauaccgcaucaugcuaagcguacacggcucacaacacuccggcaugauaguaaacgacacaggacacgaaaccgacgagaacagagccaaaguagaaaucacgcccaacucccccagggccgaagcaacccucggcggcuucggaucccuugggcuagacugcgaacccagaaccggacucgacuucagcgaccucuacuaccuaacaaugaacaacaaacacugguuagugcacaaggaaugguuccacgacaucccacuaccauggcacgcgggagcagacacuggcacaccccacuggaacaacaaagaagcucucgucgaguucaaggacgcccacgccaaaaggcaaacagucgucguccuagggagccaggaaggagccgugcacaccgcacucgcuggcgcccuggaagccgaaauggacggagccaaaggcagacuaucaagcggacacuuaaaaugcagacuaaaaauggauaaacuccgucuaaaaggcguaagcuacagccuaugcaccgccgcguucacauucaccaaaauaccagcagaaacucuccacggcaccgugacaguagaaguccaguacgccggcacggauggaccauguaaaguaccggcccaaauggcaguagacaugcaaacacucacacccguaggacgccuaaucaccgcaaaccccgugauaaccgaaucaaccgaaaacagcaaaaugaugcucgaacucgacccaccauuuggagauagcuacaucgugaucgggguaggagagaaaaagaucacgcaccauuggcaccgcucaggcucaaccauaggaaaggccuucgaagcaaccguacgaggagcaaaacgcauggcaguacuaggagacacugccugggacuucggcucaguaggcggagcacucaacucccuaggcaaaggaauacaccaaaucuucggcgccgccuucaaaagccucuucggcgguauguccugguucagccaaauccugaucggcacacuucuaaugugguuaggacucaacaccaaaaacggcuccaucucccuaaugugccuagcacucggcggcguacucaucuuccuaagcacagcaguguccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5042 - RNA, 2299 nt, Artificial Sequence
  ZIKV prME variant mRNA Design 1 opt
gggagaaagcuuaccaugagacgaggcgccgacacaucaguuggaauaguaggacuacuacuaaccacagccauggccgcagaaguaacaagacgcggauccgccuauuacauguaccuagaccgaaaugacgcaggcgaggcgaucagcuucccaacaacgcugggaaugaacaaaugcuacauacaaauaauggaccuuggccacaugugugacgcaacaaugagcuacgaaugccccaugcucgacgagggcgucgaaccagacgacguagacugcuggugcaauacaacaagcaccuggguagucuacggaacaugccaccacaaaaagggagaagcacgacgcagccgccgagcgguaacccuccccagccauucgacccggaaacuacagacccgaagccaaaccuggcuagaaucacgcgaauacaccaaacacuuaaucagaguggagaacuggaucuuccgcaaccccggauucgcacuagcagcagccgcaauagcauggcuccuaggcagcagcacaagccaaaaggucauauaccucgugaugaucuuacucauagccccagccuacagcauacgaugcauaggcguguccaacagagacuucgucgaaggcaugagcggaggcacauggguagacauaguacucgaacacggcggaugcguaacggugauggcccaagacaaaccaacaguagauaucgaacuggucaccaccacagucagcaauauggcagaaguaagauccuacugcuacgaagcauccauaagcgacauggcaagcgauagcagaugccccacacagggcgaagccuaccucgacaaacaaucagauacacaauacgucugcaagcgcacccuggucgacagaggcuggggaaauggaugcggccuauuuggaaaagggucccuggucacgugcgcaaaguucgcgugcagcaagaaaaugaccggcaaaagcauccaacccgagaaccucgaauacagaauaaugcucagcgugcacgggagccaacacagcggcaugauaguaaacgacacuggacacgaaaccgaugagaaccgagccaaagucgaaauaaccccuaacucaccacgagcagaagcgacacuagggggcuucggcagucucgggcuagacugcgagcccagaaccggccucgacuuuuccgaccucuacuaccuaaccaugaacaacaaacacuggcucgugcacaaagaaugguuccacgacaucccacucccauggcacgcaggagcagacacaggaacaccccacuggaacaacaaagaggcacucgucgaguucaaggacgcccacgcaaaaagacaaacaguaguaguucucggaagccaagaaggagcaguacacaccgcccuugcaggggcccucgaagccgagauggacggagcgaaaggccggcuaucgucaggccaccucaaauguagacuaaagauggacaaacucagacuaaaaggagugucauacagccugugcacagccgcguucacauucacaaaaauaccggcggaaacacuccacgggacggucaccguagaggugcaauacgccggcaccgacggccccugcaaagucccggcacagauggccgucgacaugcaaacccucacaccaguaggccgacuaaucacagccaacccgguaauaacggaauccacagaaaacucaaaaaugaugcuagaacucgacccaccauuuggcgacagcuacauagugauagggguaggcgaaaagaaaaucacacaccacuggcaccgaagcggcagcaccauagggaaagcauucgaagcaaccguacggggagcaaaacgcauggcaguacucggggacacagccugggacuucggcagcguaggcggugcacuaaacucacuaggcaagggcauacaccaaauauucggggcggccuucaaaucucuauucgggggcaugagcugguucucacaaauccuaaucgggacccuccucauguggcuaggacucaauacaaagaacggcagcauaucgcucaugugccuggcauuaggaggaguccuaaucuuccucagcacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5043 - RNA, 2296 nt, Artificial Sequence
  ZIKV prME variant mRNA Design 1 opt
gggagaaagcuuaccaugcgcggagcagacaccagcgucggcaucgugggccuccuucugacaacagccauggccgcggagguaacacgaagaggcagcgcguacuacauguaccuagacagaaaugacgcaggagaagccaucucguucccaacaacccuaggaaugaacaaaugcuacauccaaaucauggaccuaggccacaugugcgacgccaccaugagcuacgaaugcccaaugcucgacgaaggaguagagcccgacgacguagacugcuggugcaacaccaccagcacauggguaguauacggaaccugccaccacaaaaagggggaagcucgccgaagccgccgcgcugucacacuccccagccacagcaccagaaaacuccaaacccgcucacaaaccuggcuagaaagccgagaauacaccaaacacuuaauccgaguggaaaacuggauauucaggaaucccggcuucgcccuugccgccgccgcaauagccuggcuccucggcagcucaaccucacaaaaagucauauaccuagucaugauacuccuaauagcccccgccuacuccauaagaugcauaggcguaagcaacagagacuucguagaagggaugucuggcggcaccuggguagacauuguacucgaacacggcggcugugugacagugauggcccaagacaaaccaaccguagacaucgagcuagucacaaccaccgucuccaacauggccgaagucagauccuacugcuacgaagcgagcauauccgacauggcguccgacagccgaugccccacacagggcgaagccuaccucgacaaacaaagcgacacccaguacguauguaaacgcaccuuaguggacagaggauggggcaacggcugcggacucuucggcaagggaucccucgucacaugcgccaaauucgcaugcucgaagaaaaugaccggcaaaagcauccaaccagaaaaccucgaauaccgaauaaugcucucgguacacggcagccaacacagcggaaugaucguuaacgacaccgggcacgagacagacgaaaaccgugccaaagucgaaauaacccccaacagcccaagagcagaggccacccucggcggauucgguagccuaggacuagacugcgagcccagaaccggccuggacuucucagaccucuacuaccuaacuaugaacaacaaacacuggcuaguccacaaagaaugguuccacgacauaccccuacccuggcacgccggagcagacacaggcaccccacacuggaacaacaaagaagcccuaguagaguucaaggacgcacacgcaaaacgccaaacaguuguaguccuuggcagccaagaaggagccguccacaccgcccucgcaggagcccuagaagcagaaauggauggcgcgaaaggccgccuaucauccggccaccuaaaaugcagacucaagauggacaaacuaagacucaagggagucuccuacucccuauguaccgcagccuucacguucaccaaaaucccagcagaaacacuccacggcaccguaaccgucgaaguacaauaugccgguacagacggacccugcaagguaccagcccaaauggccguggacaugcaaacccuaacacccguaggccgccugaucacagcgaaccccguuaucaccgaauccacagaaaacucaaagaugaugcucgaacuagacccacccuucggagacuccuacauagucaucggcgucggggaaaagaaaauaacacaccacuggcaccgcuccggcagcaccauagguaaagcauucgaggccaccguacgaggagccaaacgaauggccguacuaggcgacaccgccugggacuuuggauccgugggcggcgcacuaaacucacuaggcaaaggaauacaccaaaucuucggggcagccuucaaaagccuauucggcggaaugucuugguucucacaaauccucauaggaacacuccugauguggcucggacugaacaccaaaaacggauccauaagucuaaugugccuagcacugggcggaguccuaaucuuccugagcaccgcaguauccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5044 - RNA, 2293 nt, Artificial Sequence
  ZIKV prME variant mRNA Design 1 opt
gggagaaagcuuaccaugggcgccgacacaucggucggaauagucggacuacuccucacaacagccauggcagcggaagucacgcgaagaggcuccgccuacuacauguaccucgaccgcaacgacgcaggggaagcgaucagcuuccccaccacccucgggaugaacaaaugcuacauacaaauaauggaucuaggacacaugugcgacgcgacgaugagcuacgaaugccccaugcuagacgaaggaguagaaccagacgacgucgacuguuggugcaacacaacauccacuugggugguauauggaaccugccaucacaagaaaggagaagccaggaggucccgcagagccgucacacuccccagccacuccacucgcaagcuacaaacaagaucacaaaccuggcuagaaagcagggaauauacaaaacaccuaauaagaguggaaaacuggaucuucagaaaccccggcuucgcccuagccgcagcggccauagccuggcuacucggcagcuccacaagccagaaagucaucuaccucguaaugauccuucugaucgccccagcguacuccauacgguguauaggaguauccaaccgcgacuucgucgaaggcaugucaggcggaacaugggucgacauaguccucgaacacgguggaugcgucacgguaauggcacaggacaaacccacggucgauaucgagcuaguaacaaccacggucuccaacauggccgaaguccgcucauacugcuacgaagccuccauauccgacauggcguccgacucccgcugcccaacccaaggcgaagccuaccucgacaaacaauccgacacccaauacguaugcaaacgaaccuuagucgaccgcggaugggggaacggauguggccuauucggcaagggcucgcucguuacaugcgccaaauuugccugcucgaagaaaaugacgggaaaaagcauccaacccgaaaaccuagaauacagaauaaugcuaucgguccauggaucacaacacucagggaugauaguaaacgacacgggacacgagaccgacgaaaaccgcgcgaaagucgaaauuaccccaaacaguccucgcgcagaagcaacccuaggcggguucggaagccucggccucgacugcgaaccacggacaggcuuagacuuuagcgaccuguacuaccucaccaugaacaacaaacacugguuaguccacaaagaaugguuccacgacauaccccuaccauggcacgccggagccgauacagguacaccccacuggaacaacaaggaagcgcuaguggaguucaaagacgcccacgcaaaacgccaaaccgucgucgucuuaggcagccaagaaggagccguccacaccgcgcucgccggagcccuagaagcagagauggacggagcaaaaggacgccuaaguucagggcaccuaaagugccgacugaaaauggacaagcugcgucucaaaggcguguccuacucacuaugcacggcggcauuuacguucaccaaaauccccgcagaaacccuacacggaaccgucaccguagaaguccaauaugccggaacggacggacccugcaaggucccagcccaaauggccgucgacaugcagacccugacccccguaggccggcuaauaaccgcaaacccgguaauaacagaaucaacagagaacucaaaaaugaugcucgaacuggacccacccuucggcgacuccuacauagucaucggaguaggagaaaagaaaauaacccaccacuggcaccgcagcggaagcaccauaggcaaagcguucgaggcgaccguccgcggcgccaaaaggauggcaguccuaggagacaccgcaugggacuucggaagcguaggaggcgcccucaacucacuaggaaaaggaauccaccaaaucuucggagcggcguucaaaagccucuucggcggaaugagcugguucucacaaauccucaucggaacccugcuaauguggcucggacuaaacaccaaaaacgggagcaucucccuaaugugucucgcacuagguggcguccucaucuuccucagcacagcaguaucagcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5045 - RNA, 2290 nt, Artificial Sequence
  ZIKV prME variant mRNA Design 1 opt
gggagaaagcuuaccauggccgacacaagcguaggaauaguaggacugcuccugaccacagcaauggcagcagaaguaacaagacgaggcuccgcguauuacauguacuuagaccgaaacgacgccggagaagccauaucuuuccccaccacccuagggaugaacaagugcuacauucaaauaauggacuugggccacaugugcgaugcgaccaugagcuacgagugccccaugcuagacgagggcgucgaaccagacgacguagacugcuggugcaacacgaccucaacauggguaguauacgggacaugccaccacaagaaaggagaggcacgaagaagccgacgagccguaacgcuacccucccacucgacacgcaaacuccaaacaagaucccaaacauggcuggaaagcagggaauacacaaaacaccucauuagaguagaaaacuggauauuucgaaacccaggcuucgcccuagcagcagcagcgaucgccuggcuccucggaagcagcaccucgcaaaaaguaauuuaccucguaaugauacuacuaaucgcgccagcauacagcaucagguguaucggaguaagcaacagagacuucguagaaggcaugucaggaggaaccuggguagacaucguacuagaacacggaggaugcguaaccgugauggcucaagacaaaccaaccguagacaucgagcuaguaaccacuacagucuccaauauggcugaagucagauccuacugcuacgaagccucaauuagcgacauggcgagcgacagccgaugcccgacccaaggagaagccuaccucgacaaacaaucggacacccaauacguaugcaaaaggacacuggucgaccgaggcugggggaacggcugcggccuguucgggaaaggcagccucguaacaugcgcgaaauucgccugcuccaagaaaaugacuggaaaaucaauccaaccagaaaaccuggaauacagaaucaugcucuccguacacgggagccaacacagcggaaugaucguaaacgacaccggccacgaaaccgacgaaaaccgcgcgaaagucgaaauaacgcccaacucacccagagccgaggccacacuaggagguuucggaucacuagggcucgacugcgaacccaggaccggacuagacuucagcgaccucuacuaccucacaaugaacaacaaacacuggcuagugcacaaagaaugguuucacgacauaccccuacccuggcacgcaggcgcagacaccggcacgccccacuggaacaacaaagaagcacucgucgaguucaaagacgcccacgccaaacgccagaccguagucguccuaggaagccaagaaggagcaguccacaccgcccuagcaggggcucuagaagccgaaauggacggcgcaaagggacgacucagcagcggccaccuaaaaugccgccugaaaauggacaaacucagacucaaaggaguaucauacucacuaugcacagcagcauucacauucaccaaaauccccgcagaaacccuccauggaacagucacagucgaaguucaauaugccggcacagacggaccaugcaaaguacccgcacaaauggccguagacaugcagacgcuaacccccgucggaaggcucauaacagcuaaccccgucauaaccgaaagcacagaaaacuccaaaaugaugcucgaacucgaucccccguucggcgacucguacauugucauaggcgucggagaaaagaaaaucacacaccacuggcaccgcucaggcagcacaaucggcaaagccuucgaagcgacaguacggggagccaaacgaauggccguccucggagacacagccugggacuucggaagcgucggaggagcccuuaacagucugggaaaaggaauccaccaaaucuucggggcagcuuucaaaagccucuucggcggcaugagcugguucagccaaauccuaaucggaaccuuacuaauguggcucgggcugaacacgaaaaacggguccauaagccucaugugccucgcccugggcggaguccucauauuccuaagcacagccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5046 - RNA, 2287 nt, Artificial Sequence
  ZIKV prME variant mRNA Design 1 opt
gggagaaagcuuaccauggacacaagcgucggaauagugggucuccuacucacgaccgcaauggccgcagagguaacccgaaggggcucugcauacuacauguaccuggaccgcaacgacgcaggcgaagccauaucauuccccacgacacucggaaugaacaaaugcuauauacagaucauggaccucggacauaugugcgacgccaccauguccuacgaaugccccaugcuagacgaaggcguggaaccagacgacgucgacugcugguguaacaccacgagcaccuggguagucuacggcacaugccaccacaagaaaggggaagccagaagaucacgccgagcgguaacgcucccgucacacuccacaagaaaacuacagacacgaagccaaaccuggcucgaaagccgcgaauacaccaagcaccuaauaagaguagagaacuggauuuuccgaaacccuggguucgcgcuagcagcugcagcaauagccuggcuccuagggagcucaacgucacagaaagucaucuaccucgucaugauacuacugaucgcacccgccuacuccauccgaugcauaggcgucucaaaccgcgacuucguagaaggcauguccggagggaccugggucgauaucguucucgaacacggaggaugcguaacagucauggcccaggauaaacccacaguagacauagaacucguaacaacgacagucucaaacauggccgaaguaagguccuacugcuacgaagcaucaaucucggacauggccuccgacucacgaugccccacccaaggcgaagccuaccucgacaaacaaucagacacccaauaugucuguaaacggacccucguagaccgcggcuggggcaacggaugcggccuauucggcaaaggcucccuagugaccugcgccaaauucgcaugcucaaagaaaaugacaggcaaaagcauacaacccgaaaacuuagaauaccguaucaugcuuuccguacacggcagccaacacuccggcaugaucgucaaugacaccggccacgaaacugacgaaaauagagcaaaaguagaaaucacaccaaacagcccacgagcggaagcgacgcucggcggcuuuggcucacucggccucgacugugagccaagaacaggacuagacuucuccgaucuauacuaccucacgaugaacaacaaacauuggcuaguacacaaagaaugguuucaugauaucccccuaccuuggcacgccggagccgacacaggaacaccucacuggaacaauaaagaggcacucguagaguucaaagacgcacacgccaaaagacaaaccguagucguccuuggcucacaagaaggcgccguacacaccgcccucgccggagcacucgaagccgagauggacggcgccaaaggccgacuaucuagcggccaccucaagugcaggcucaagauggauaaacuacgacucaagggaguaucauacucccuaugcaccgcagcauucacguucacaaaaauacccgcagaaacccuacacggcacagucacaguggagguacaguacgccggcacagacggaccauguaaagucccagcacagauggccguugacaugcagacccuaacccccgucgggagacucaucacagcaaacccaguaaucacagaaagcacagaaaacucaaagaugaugcucgaacuugacccacccuucggcgacuccuacaucgucauaggaguaggagagaagaaaauaacccaccacuggcaccgcuccggaaguacaauaggcaaagcauucgaagccaccguccgaggcgcaaaacgcauggcgguccuaggcgacaccgcgugggacuucggaagcgucggcggcgcacucaacucucugggaaaaggcauacaccagauuuucggcgcagccuucaaaucccuauucggcggcaugagcugguucagccaaauacucaucggcacucuccuaauguggcuaggccucaacacgaaaaacggcagcauaagccuaaugugccucgcccuaggaggaguccuaauauuccuaucaacagcagugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5047 - RNA, 2284 nt, Artificial Sequence
  ZIKV (strain ZikaSPH2015) Polyprotein(108-794) mRNA Design 1 opt
gggagaaagcuuaccaugaccagcgucgggaucgucggccuccuacuaaccacagcaauggcagcagaaguaaccaggcgcgguuccgccuacuauauguaccucgacagaaacgacgcgggcgaagccaucuccuuuccaaccacacucggcaugaacaaaugcuacauccaaauaauggaccucggacacaugugcgacgccacgauguccuacgaaugucccaugcuagacgaaggugucgaaccagacgacguagacugcuggugcaacaccaccagcaccugggugguauacggcacaugccaccacaagaaaggcgaagccagacgaucgcgccgagccgucacgcuccccucccacucgaccagaaaacuacaaacccgcucucagaccuggcucgaaucgcgagaauauaccaaacaccuuauacgagucgaaaacuggauauuccgcaacccaggauuugcauuagccgccgcagcaaucgccuggcuacucgggagcucaacaucacaaaaaguaauuuaccucgucaugauccugcucauugccccagcuuacucaauacgauguaucgggguaagcaaccgagacuuugucgaaggcaugagcggagggaccugggucgacaucguccucgaacacggcggcugcguaacagucauggcccaggauaaacccaccgucgacauugagcuagucacaaccacagucucgaacauggccgaaguacgcagcuacugcuacgaagcguccauaagugacauggccagcgacucccgcugccccacucaaggcgaagccuaccucgauaaacaaagcgacacccaauacguaugcaaaagaacccucgucgaccgaggcuggggcaacgguugcggccuauucggaaaaggcucccuaguuaccugcgcaaaguucgcaugcucaaagaaaaugaccggcaaauccauccaaccagaaaaccuggaauaccgcauaaugcugagcguccacggcucccaacacuccggaaugaucgucaacgacacagggcacgaaacggacgaaaaccgcgcaaaaguugaaauaacccccaauagcccccgcgcagaagcaacacucggcggcuucggaagccuagggcucgacugcgaaccccgcacaggccucgacuucuccgaccuguacuaccuaaccaugaacaacaaacacuggcucguccacaaagaaugguuccacgacaucccacuaccauggcacgcgggugcagacacaggcacaccccacuggaauaacaaagaagcccucguagaguucaaagaugcccacgcaaaaagacagaccgucguaguccucggcagucaagaaggcgccguccacacggcucucgccggagcccuagaagccgaaauggacggagcaaaaggaaggcuauccucaggccaccucaaaugcaggcucaagauggacaaacuaagacucaaaggcguaagcuacagccucugcacagccgcauucaccuucacgaaaauucccgcggaaacgcuacacggcacagugacagucgaaguccaguacgcaggcacagacgggccaugcaaaguacccgcacaaauggcggucgacaugcagacacucacccccguaggaagacuuaucacagcaaaccccguaaucacagaauccacagaaaacagcaaaaugaugcuagaacuagauccacccuucggagacuccuacaucguaauaggcgucggagaaaagaaaaucacucaccauuggcacagaagcggcuccacaauagggaaagccuucgaggcgacaguacgcggagcuaaacgcauggccguacucggggacaccgccugggacuucggcuccgucggcggcgcacuaaacagucucggcaaaggaauacaccaaaucuucggcgccgccuucaaaucccuauucggaggcaugagcugguucagccaaauccugauaggcacauugcucaugugguuaggccucaacaccaaaaacggcagcaucagccucaugugccucgcacucgggggaguacuaauauuccuauccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5048 - RNA, 2284 nt, Artificial Sequence
  ZIKV prME variant mRNA Design 1 opt
gggagaaagcuuaccaugaccuccguaggcaucgugggacuccuccucacaaccgcaauggccgcagccguaaccagacgcggcuccgcauauuacauguaccucgacagaaacgacgccggcgaagcgaucucguuucccaccacccucgggaugaacaaauguuacauccaaaucauggaccucggccacaugugcgacgccaccaugagcuacgaaugccccaugcuagaugaaggaguagaaccagacgacguagacugcuggugcaacaccacaucaacauggguaguguacggcacaugucaccacaagaaaggugaagcacggcgcagcagacgcgcgguaacgcuccccucacacuccacacgcaaacuccaaaccagaagccaaaccuggcuagaaagccgagaauacaccaaacaccucauacgagucgaaaacuggauauucagaaaccccggauucgcccucgcggccgcggcaauagcuuggcuacucggauccucgaccucacaaaaagucaucuaccuggucaugaucuuacucauagcaccagcauacucgauccgguguaucggcgugucuaaccgcgacuuugucgagggcauguccggcggcaccuggguggacaucguccuagaacacgggggcugcgucaccguuauggcccaagacaaacccacgguagacauagagcucgucaccaccacaguauccaacauggccgaaguccgaucauacugcuacgaagccuccauaagcgacauggccucagacucccgcugccccacacaaggugaagcauaccuagacaaacaaucagacacgcaauacgugugcaaacgcacucuggucgaccgaggcuggggcaacggcugcggccucuucggcaagggaagccuaguaaccugcgccaaauucgccugcucaaagaaaaugaccggcaaaucaauccaacccgaaaaccucgaauaccgaaucaugcuaucaguccacggaucacagcacucuggcaugauagucaacgacacaggucacgaaacagacgaaaaccgcgccaaaguugaaaucacccccaacucaccucgagcagaagccacccucggaggauucggcucccuaggccuagacugcgaaccacgcacaggacuagacuucagcgaccucuauuaccucaccaugaacaacaaacauuggcuaguucacaaagaaugguuccacgacauaccccucccauggcaugccggugcagacaccggaacaccucacuggaacaacaaggaagcccucguagaguucaaggacgcacacgcaaaacgacaaacagucguaguccucggaagccaggaaggagccguucacaccgcacuugcaggagcccuggaagccgaaauggacggugccaaaggccgccuuuccucagggcaccucaaaugccgccucaaaauggacaaacuacgccucaaaggcgucucuuacucccucuguacugccgccuuuaccuucaccaagauaccagcagaaacucugcacggcaccgucacagucgaaguacaauacgcuggcaccgacggacccugcaaaguccccgcccaaauggccgucgacaugcagacccuaacccccguaggaagacuaaucacagccaauccagucaucaccgaauccacagaaaacucaaaaaugaugcucgaacucgauccacccuucggagacagcuacauugucaucggcgucggugaaaagaaaauaacacaccacuggcaucgaucaggcucaacgaucggaaaagcguucgaagcuacaguacgaggcgccaaacggauggccguccucggcgacaccgcuugggacuucggcuccgucggaggugcacucaacucacucggcaaagguauccaccaaaucuucggcgcagcguucaagagccucuucggcggcaugucaugguuuucacaaauacucauaggaacacuacucauguggcucgggcucaacacaaagaacggcagcauaagccucaugugccucgcacuuggcggcguccuaaucuuccuaucgacagcaguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5049 - RNA, 2296 nt, Artificial Sequence
  ZIKV prME variant mRNA Design 1 opt
gggagaaagcuuaccaugcgcggcgcggacacaucagucggcaucgucgggcuacuacucacgacggccauggcagccgcugucacaagacgaggaagugccuauuacauguaccucgaccgcaacgacgccggggaagccaucuccuuccccacaacacucggcaugaacaaaugcuacauccaaaucauggaccucggccauaugugcgacgccaccaugucauacgagugcccaaugcuagacgaaggagucgagccagacgacgucgacugcugguguaacacaaccuccacauggguaguuuauggcacgugucaccacaaaaagggcgaagcccgccgaagccgcagagccgucacccuaccuucacacagcacccgcaagcuacaaacacgcagccaaaccuggcuggaaucacgagaauacacaaagcaccuaauacgcgucgagaacuggauauuccgcaaccccggcuucgcacuagcggccgcagcgaucgcauggcuccucggcuccagcacaucgcaaaaggucaucuaccucguaaugauacuccuaaucgcacccgcguauagcauacgguguauaggcgucagcaaccgagacuucguagaaggcaugagcggugguacaugggucgacaucguccucgaacacggaggcugcgucacagucauggcacaagacaagccaacaguagacaucgaacuuguaaccaccaccguuagcaacauggcugaaguuagaucauacugcuacgaagccagcauaagcgacauggccucagacagccgaugcccaacgcaaggagaagccuaccuagacaaacaaucggacacccaauacgucugcaaacgaacccuagucgaccgcggcuggggaaauggaugcggccuauucggaaaaggaucccucgucacaugcgccaaauucgcgugcucaaagaaaaugaccggcaaaagcauacaaccagaaaaccuagaauacagaauaaugcucucaguccacggcagccaacacagcggcaugaucgucaacgacacaggccacgaaaccgacgaaaacagagcaaaagucgagauuacaccuaacaguccacgcgcugaagccacccuaggcggauucggaucgcuaggccucgacugcgaaccacguaccggacuagacuucuccgaccuauacuaccucacaaugaacaacaaacacuggcucguacacaaagaaugguuccacgacauaccccuacccuggcacgccggagcagacaccgggacaccacacuggaacaacaaagaagcccucgucgaguucaaagacgcccacgcaaaacgccaaacagucgucguauugggcucccaagaaggggcaguccacacagcccucgcgggagcccuagaagcagaaauggacggcgccaaaggacgacuaagcuccggccaccuuaagugcagacucaaaauggacaaacugcgacuuaaaggagucucauacucacucugcacagcagcuuucacauucacaaaaauaccagcagaaacccuucacggcacagugacgguagaaguccaguacgccggaaccgacggccccugcaaaguacccgcccaaauggccguagacaugcaaacgcuaaccccaguuggacgucucauaacagcuaacccaguaaucaccgaaucgacugaaaacucgaagaugaugcuagaacucgacccaccauucggcgacagcuacaucguaaucggcgucggcgagaaaaagauaacucaucacuggcaccgcagcgguagcacaaucggcaaagccuucgaagccacgguaaggggagcaaaacgcauggcaguccugggggacaccgcaugggauuucggaucggugggcggggcccuaaacucacugggcaaaggaauccaccagaucuucggcgccgcuuucaaaucacucuucggcggcauguccugguucucacaaauacucaucggaacacuacucauguggcucggacucaacaccaaaaacggaagcauaagccucaugugccucgcacuaggaggaguccucauuuuccucucaaccgccguuuccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5050 - RNA, 2320 nt, Artificial Sequence
  ZIKV prME variant mRNA Design 1 opt
gggagaaagcuuaccaugcgcggccugagcagcagaaaacgacgaucacacgacguacucacaguccaauuccucauacucggaaugcuacucaugaccggcggggucacgagaagaggcagcgcauacuacauguauuuagaccgaaacgacgccggcgaagccaucuccuuccccaccacacugggcaugaacaaaugcuacauccaaaucauggaccuaggacacaugugcgacgcgaccaugucauacgaaugcccgaugcucgacgaaggcgucgaaccagacgacgucgauugcuggugcaacaccacauccaccuggguaguauacggcacaugccaccacaagaaaggagaagcccgacgcagccggcgcgcugucacccucccgucacacucuacccgaaagcugcaaacccgaucacagaccuggcuggaaucacgcgaauacacaaaacaccucauccgcgucgaaaacuggauauuccgcaaccccggcuucgcccuagcagcugcagccaucgccuggcuacucggcuccagcaccagccaaaaggucaucuaccucguaaugauccuccucauagccccagcauacucaauccgaugcaucggagugagcaaccgugacuucgucgaaggaauguccggcgggacaugggucgauauugugcucgaacacggaggcugcgucacaguaauggcccaagacaaaccaaccguagacauagagcucguuaccaccaccguauccaacauggccgaagugcgcuccuacugcuacgaagcaagcaucagcgacauggccuccgauucaagaugccccacgcaaggcgaagcauaccuagacaaacaaucagacacacaauacgucugcaaacgaacccucgucgacaggggaugggggaacggcugcggccuuuuugggaaaggaucccuagucaccugugccaaauuugcaugcagcaaaaagaugaccggaaaaucaauucaaccagaaaaccucgaauaccgaauaaugcucucaguccacggcagccagcacagcggaaugaucguaaacgauacaggccacgaaacagacgaaaaccgcgccaaaguagaaauaacacccaacucaccccgcgcagaagccacacuagguggauucgggagccuaggacuagacugcgaaccccgcacaggucuagacuucuccgaccucuacuaccucacaaugaacaacaagcacuggcuaguccacaaagaaugguuccacgacaucccgcuaccauggcacgccggcgccgacaccggaacaccccacuggaacaacaaagaagcccuagucgaguucaaagacgcacacgcaaagagacaaacugucguaguccucggcucccaagaaggcgccguccauaccgcacucgcaggcgcauuagaagccgagauggacggcgcaaaaggacgacuaagcagcggacaccucaaaugccgccuaaaaauggacaaacugagacucaaaggagucucuuacucacucugcaccgccgcauucaccuucacgaaaauccccgccgaaacccuccacgguaccguuaccgucgaaguccaauaugcagggacagacggcccaugcaaaguccccgcccaaauggcagucgacaugcagacccucacgccagucggcagacuaaucacagcaaaccccgucauaaccgaaagcacggaaaacuccaaaaugaugcucgaacuagaucccccauucggcgacucauacaucgucaucggaguaggugagaaaaagaucacccaccacuggcacagaagcggaagcacgaucgguaaagccuucgaagccacuguccgaggugccaaacgcauggcugugcucggagacaccgccugggacuucgggagcgugggcggagcccuaaacagccuagggaaaggcauacaccagaucuucggcgcagcauucaagagcuuauucggcgggaugagcugguucucacaaauccucaucggaacacuccucauguggcuaggacucaacaccaaaaacggaagcauaagucugaugugccucgcccucggaggaguccuuauauuccuauccacagccgucagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5051 - RNA, 2320 nt, Artificial Sequence
  ZIKV prME variant mRNA Design 1 opt
gggagaaagcuuaccaugagaggccuaucaagccgcaaaagacggucacacgacguauuaacaguacaauucuuaauccuaggcaugcugcuaaugacaggggcaguuacccgccgaggcucagcguacuacauguaccuggaccguaacgacgccggcgaagcaauuagcuucccaaccacacucgggaugaacaaaugcuacauccaaauaauggaccuaggacacaugugcgacgccacaaugucguacgaauguccaaugcuagacgaaggcgucgagccagacgacgucgacugcuggugcaauacaaccagcacaugggucguauacggaaccugccaccacaagaaaggcgaagcccgccgaucccgccgcgcaguaacccuccccagccacagcacccgaaaacuccaaacccggagccaaacauggcuagagagcagggaguacacaaaacaccugaucaggguagagaacuggauauuccgaaaccccggauucgcacucgccgccgcagcuaucgccuggcuacucggauccuccaccucucaaaaggugaucuaucuuguaaugauccuccucauagcacccgccuacucaauacgcugcauaggaguuagcaacagagacuucgucgaaggcaugagcggcggaacaugggucgacaucguccucgagcacggcggaugcgucacagucauggcccaggacaaaccaaccguagacauagagcuaguaacaacaacaguauccaauauggccgaaguccgcuccuacugcuacgaggcaucaaucucagauauggccucagacucgcgauguccaacccaaggggaagccuaccucgacaagcagagcgacacacaguacguauguaaaagaacccuuguugaccgaggcuggggaaacggaugcggccuauuugguaaaggaucacucguaaccugugccaaauucgcaugcuccaagaaaaugaccggcaaaagcauacaacccgagaaccucgaauaccgcauaaugcucagcguacacggcagccaacacagcgggaugauaguaaacgacaccggacacgaaaccgacgaaaaucgagcgaaaguagaaauaacaccaaacagcccaagagccgaagccacccucggcggauucggaagccucggacuagacugcgagccgcgcacagggcucgacuucuccgaccucuacuaccucacaaugaacaacaaacacuggcucguccacaaagaaugguuccacgacauaccacuccccuggcacgccggcgccgauaccggcaccccacacuggaacaacaaagaggcccuggucgaguucaaagacgcgcacgccaagcgccaaacaguggucguacucggaucacaagaaggcgcaguacacacagcccucgccggagcccucgaagccgaaauggacggcgccaaaggacgccuaagcuccggccaccucaagugccgccucaaaauggacaaauugcgacucaagggagucagcuacucacugugcacagccgccuucacauucacaaaaauccccgccgaaacacugcacggaacagucacaguagaaguacaauacgcaggcacugacggaccauguaaaguaccggcgcaaauggcagucgacaugcaaacccucacgccagucggacgacuaaucaccgccaauccagucaucacagaaagcacagaaaacucaaaaaugaugcuagaacuagaucccccauucggagacagcuacaucgugauaggcgucggcgaaaagaaaaucacccaccacuggcaccgaagcggcucaaccauaggcaaagcguucgaagccaccgucagaggcgcuaaacggauggcaguacucggcgacacggcaugggacuucgguucagucgggggcgcgcuaaacagccucggcaaaggaauccaccaaauuuucggggccgcauucaaaagccucuucggcggaaugaguugguucucccaaauacuaaucggcacccuccugauguggcuaggccuaaacaccaaaaacgguucgaucagccucaugugccuagcguugggaggcgugcuaauauuccuaagcacagccguaagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5052 - RNA, 2359 nt, Artificial Sequence
  KU321639.1 prME-long mRNA Design 1 opt
gggagaaagcuuaccaugcgaauaauaaacgcaagaaaggaaaagaaacggcgcggcgcagacacauccgucggaauagugggacuccuacucacaaccgcaauggccgcggaaguaacaagaagaggcucagcguacuacauguaccuagaccgcaacgacgcaggagaagcaauauccuuccccacaacccucggcaugaacaaaugcuacauacagaucauggaccucggacacaugugcgacgcaaccaugagcuacgaaugcccaaugcuagaugaaggcgucgaacccgacgacgucgacugcuggugcaacaccaccuccacguggguagucuauggaaccugccaccacaagaaaggcgaagcccgaagaucaaggagagcagucacacuaccaagccacagcacacgaaaacuacaaacacguucacaaaccuggcucgaauccagagaauacacaaaacaccucauacgagucgaaaacuggauauucagaaaccccggcuucgcccucgcggcagccgcgauagcauggcugcugggaagcaguaccucacaaaaagucauauaccuaguaaugauccuccucaucgcgcccgccuacagcauucgcugcauagguguaagcaaccgggacuucguagaagggaugagcggcgguacaugggucgacaucguacuagaacacgggggcugcguuacaguaauggcacaagauaagcccaccguagacauagaacucgucacaacaaccguaucaaacauggcugaggucagaagcuacugcuacgaagcauccaucuccgacauggcaagugacagucgcugccccacccaaggagaagcguaccucgacaaacaauccgacacccaauacgucugcaaacgaacacucguagaccgcggauggggaaauggcuguggacuuuucggaaaaggcagccuaguaacaugcgccaaguucgccugcagcaagaaaaugacaggcaaaucaauccaaccagaaaaucucgaguaccgcauuauguuaucaguacacggcagccaacacagcggcaugaucgucaacgauaccgggcacgaaaccgacgaaaacagagccaaaguagaaaucacaccaaacagcccaagagcagaagccacacuugggggcuuuggcagccuaggccucgacugcgaaccacgaacaggccucgacuucucagaucuauacuaccucaccaugaacaacaaacacuggcucguacacaaagaaugguuccacgacaucccccuccccuggcaugccggggcagacacgggaacaccccauuggaacaauaaagaagcccuaguagaauuuaaagacgcccacgccaaaagacaaaccgucgucguccucggcagccaagaaggggccguccacaccgcucuagccggggcccucgaagcagagauggacggagccaagggacggcuaagcuccggccaccuaaaaugcagacucaagauggacaaacuaaggcucaagggggucucauacagcuuaugcacagccgcauucacauucaccaaaaucccggcagagacauuacacggcacagucaccgucgaaguacaauacgcaggcacagacggcccaugcaaagucccagcccaaauggcgguagacaugcaaacacucacccccgucggccgccuuaucacagccaacccagucaucaccgaaagcacggaaaacagcaagaugaugcucgaacucgacccacccuucggcgacucguacauaguaaucggagucggagagaaaaagauaacccaucacuggcaccgcagcggcuccaccauaggcaaagccuucgaagcgaccguacgcggcgcaaaacggauggccguacucggcgacacugccugggacuucggaucaguaggcggcgcccucaacucacuaggcaagggaauccaccaaaucuuuggcgcagccuucaaaagccuauucggcggaaugucgugguucagccaaauccucauaggcacguuacucauguggcucggccuaaacaccaaaaacggcuccaucucccuaaugugccucgccuuaggcggaguccugaucuuccucagcacagcaguaucggccgacguaggaugcuccguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5053 - RNA, 2359 nt, Artificial Sequence
  KU312312.1 prME-long mRNA Design 1 opt
gggagaaagcuuaccaugagaauaauaaacgcgcgcaaagaaaagaaacgacgcggcgcagacacaagugucggaaucgucggccuccugcugacgacagccauggcugcagaagucacacgcagaggaagcgccuacuacauguaccuagaccgaaacgacgcaggcgaagccauaucauucccaacaacgcucggcaugaacaaaugcuacauucaaauaauggaccuagggcacacaugcgacgcaacgaugagcuacgaaugccccaugcucgacgaaggagucgaaccagacgacguagacugcuggugcaacacgaccagcacgugggugguauacggaaccugccaccacaagaaaggggaagcacgaagaucacgacgcgccgugacccuccccagucacagcacacgaaaacuccaaacacgcucccaaacauggcuagaaucacgcgaguacacgaaacaccucauccgagucgaaaacuggaucuuuagaaacccaggcuuugcacucgcagcggccgccauugcauggcuacugggcaguagcacaucccagaaaguuauauaccucguaaugauacuucuaauagcgcccgcauacuccauccgcugcauaggaguguccaauagagacuucguagaaggaaugagcggaggcaccuggguagacguagucuuagaacacggaggcugcgucacagucauggcccaagacaaaccgaccguagauauagaacucguaaccaccacagucagcaacauggcagaagugcgaucauacugcuacgaagccucaaucuccgacauggccagcgacagccggugcccaacacaaggagaagccuaccucgacaaacaaucagacacccaauaugucuguaaacgcacacucgucgacagaggguggggaaacggcugcggccucuucggcaaagggucacucgucacgugcgcaaaauucgcaugcagcaagaaaaugacgggcaaauccauccaacccgaaaaccucgaauaccgaauaaugcucagcguccacgggucacaacacagcggaaugauagucaaugacaccggacacgaaacagacgaaaacagagcaaaaguagaaaucacaccaaacucaccgcgagccgaagccacacugggaggauucgggagucucggccucgacugcgaaccccggacuggccuagacuucuccgaccuauacuaccuaacgaugaacaacaaacauuggcucguccacaaagaaugguuccacgacaucccacucccguggcacgccggcgccgacaccggcacuccccacuggaacaacaaagaagcccuugucgaguucaaagacgcccacgcaaaacggcaaacaguaguagucuuagggucacaggagggcgccguucacaccgcccucgcuggggcgcuugaggccgaaauggacggcgccaaaggccgccucuccagcggacaccugaaaugccgacuuaaaauggacaaacuacgacuaaaaggagucuccuacagccucugcacagcagccuucaccuucacgaagaucccagccgaaacacuacacggaacagucacaguagaaguacaauacgcagggaccgacggcccaugcaaaguccccgcccaaauggccguagacaugcagacacuaacgcccguaggaagacucaucacagcaaacccgguaaucaccgaaagcaccgaaaacuccaaaaugaugcuggaacucgaucccccauucggagacagcuacauagucaucggaguaggagaaaagaaaauaacacaccacuggcaccgcagcggaucaaccauaggaaaagccuuugaagccaccguaagaggcgcaaaaaggauggcgguucugggggacacagcaugggacuucggcuccguaggcggcgcacuaaacucccucggcaaaggaauacaccaaaucuucggagcagccuucaaaucucucuucggcggaaugagcugguucagccaaauccuaauaggcacgcuacucauguggcuaggacuaaacgccaagaacggauccaucagccuaaugugccuggcucucggcggcguguuaauauuccuuagcacagcagucuccgccgacguaggcugcagcguagacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5054 - RNA, 2347 nt, Artificial Sequence
  AY632535.2 prME-long mRNA Design 1 opt
gggagaaagcuuaccaugcgcaucauaaacgcgcgcaaagaacgcaaacgaagaggcgcagauacaagcauaggaauaaucggacuccugcucacaacagcgauggcagcagagaucacacgaagggggucagccuacuacauguaccucgacagguccgacgcaggaaaagcaauaucauucgcaaccacacuaggagucaacaaaugccacguacaaaucauggaccuaggacacaugugcgacgccacaaugucguacgaaugcccgaugcuggacgaaggaguggaaccggacgacguagacugcuggugcaacacaacaaguacguggguggucuacggaacgugccaccacaagaaaggagaagcccgacgaagcagacgagcaguaacacugcccagccauucaacaagaaaauugcaaaccagaucccagacauggcuggaaagcagggaauacaccaaacaccucauaaagguagaaaacuggauauuccgaaaucccggauucgcacucguagccguagcaauagccugguuacugggcucaagcacaagccaaaaaguaauauaccuagugaugauacuccugaucgcccccgcguacucgauccgaugcauaggagucagcaaccgggacuuuguugaagggaugucaggaggaacauggguagacgucgugcucgaacacggaggcugugugacaguaauggcgcaagacaaacccacggucgacauagagcuaguaacaacaacuguaagcaacauggcagaagugagaagcuacugcuacgaagccucgaucucagacauggcaagcgauagccgaugcccuacgcaaggagaagccuaccuggacaaacagucagacacccaguacgucugcaaacggacacuggucgaccgcggcuggggcaacggcugcggccucuucgggaagggaucacucgugaccugcgcaaaguucacgugcagcaagaaaaugaccggcaaaagcauacaaccagaaaaccuagaauaccgaaucaugcucucaguacacggcucgcaacacucaggaaugaucggauacgaaacagacgaagaccgagcaaaaguagaagucacuccaaacagcccgcgcgcagaagcaacacuagggggcuucgggagccucgggcuagacugugaaccacgcacgggacuggacuucagcgaccucuauuaccuaacgaugaacaacaaacacuggcugguccacaaagaaugguuccacgacaucccacuuccguggcacgccggagccgacaccggcacaccccacuggaacaacaaagaagcccuagucgaguucaaggacgcccacgcuaaaagacaaaccgucgucguccucggcucacaagaaggagcgguccacaccgcgcucgcgggcgcucucgaagcggagauggacggugccaaaggacgcuuauucuccgggcaccuaaagugcaggcuaaaaauggacaaauuaagacucaaaggaguauccuacucgcucuguaccgcagccuuuaccuucacaaaggucccagccgaaacccuacacgggacagugacaguugaaguccaguacgccggcacagacggaccaugcaaaaucccgguacagauggcgguagacaugcaaacauugacaccagugggacgccucauaacugcuaacccaguaauaacagaaucaaccgaaaacaguaaaaugaugcuggagcuggacccgccauucggagacagcuacaucgugauaggaguaggagacaagaaaauaacacaccacuggcacaggagcggcagcaccaucggaaaagcauuugaagcgacagucaggggcgcgaaaagaauggcaguacuaggggacaccgcaugggacuuugggagcgugggaggaguuuuuaacagcuuaggaaaaggcauccaccagaucuucggagccgcauucaagagcuuguucggaggcaugagcugguucagccaaauacuaauagggacccuccuggucuggcuugggcugaacaccaaaaacggaagcaucagccugacaugccucgcacuaggaggcguaaugauauuccuaagcacagccgugagcgcggacguggggugcagcguggacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5055 - RNA, 2359 nt, Artificial Sequence
  KU527068.1 prME-long mRNA Design 1 opt
gggagaaagcuuaccaugcgaaucauaaacgcacggaaagaaaagaagagaagaggagcagacaccagcguagggaucgugggccugcuccucacaacggccauggccgccgaagucacccgcagaggaucagcuuacuacauguaccuagaccgcaaugacgcgggcgaagcaaucagcuuccccacgacccuaggcaugaacaaaugcuacauacaaauaauggacuuaggccacaugugcgacgcaaccaugaguuacgaaugcccgaugcuggacgaaggggucgaaccagacgacguagacuguugguguaacaccacaucaacaugggugguguacgggaccugccaccacaagaaaggcgaagccaggcgaucgagacgagcuguaacccuaccaagccacagcaccagaaaacuacaaacgagaucacaaacguggcuggagucacgcgaauacaccaaacaccucauccgaguugagaacuggauauuccgaaacccggguuucgcauuggcagcggccgccaucgccugguuacucggaagcucuacgagccaaaaggucaucuaccuaguaaugauccuccucauagcaccagcauacagcauccgcuguauuggcgucagcaacagggacuucguagaaggcaugagcgggggcacaugggucgacguaguacuugaacacggcggcugcgucaccguaauggcacaagacaaacccacagucgacaucgaacucguaacaacgaccguaagcaacauggcggaagugcgaagcuacugcuacgaagcaucaaucagcgacauggcgagcgacagcagaugcccuacccagggcgaagcauaccucgacaaacaaagcgacacacaauacguaugcaagagaacucuagucgaccgaggguggggcaacggaugcggacuauucggaaaaggcagccucgucacaugugcaaaauucgccugcucaaagaaaaugacagguaaaagcauacaacccgaaaaccuggaguaccgcauaaugcuaagcguacacgggucccaacacagcggcaugauagucaacgacaccggacacgagacagacgaaaaccgagccaaaguggaaauaaccccaaacagcccaagggcagaggccacccuaggaggguucggcagccucggccucgacugcgaaccacgcaccggccuagacuucucagaccuauacuaccucacaaugaacaacaagcacuggcucguacacaaagaaugguuccacgacaucccccuuccauggcacgcgggagccgacaccggaacgccccacuggaacaacaaggaagcgcucguggaguucaaagacgcccacgcaaaacgacaaaccgugguaguccuaggaagccaagaaggggcaguacacaccgcacucgccggagcacuagaagcggaaauggacggagcgaaagggagacucagcagcggacaccugaaaugucgacucaaaauggacaagcuacggcugaagggagugagcuauucccucugcacagcagccuucacauucacaaaaaucccggccgaaacacuacacggaaccgucacuguggagguacaauacgccggcacagacggccccugcaagguaccagcccaaauggcaguagacaugcaaacacucacaccagugggccgccuaauaacggcaaauccaguuauaaccgagagcacggaaaacuccaagaugaugcucgaacucgaucccccguucggagacucauacauaguaauaggcguaggggagaaaaagaucacccaccacuggcacagauccggcucgacaauaggaaaagccuucgaagccaccguacgcggagcaaaaagaauggcgguacuaggagacacagcaugggacuucggauccgugggcggagcccuaaacucccucggaaagggaauacaccagauauucggagcggcauucaaaucccuauucggaggaaugagcugguucagccagauccucauaggaacacuacuaauguggcuaggucucaacaccaaaaacggaagcauuagccucaugugccucgcacuaggcgguguacuaauuuuccuaagcacagccguaucagcggacguaggaugcagcguagacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5056 - RNA, 2359 nt, Artificial Sequence
  KU720415.1 prME-long mRNA Design 1 opt
gggagaaagcuuaccaugcggaucauaaacgccaggaaagaacgaaaacggagaggagcagacacgagcauuggcaucaucgggcuacuacuaacgaccgcgauggcggcggagaucacacgaagaggaagcgcauacuacauguaccuggacagguccgacgccggaaaagccauuucauuugccacaacacuagggguaaauaagugccacguacaaauaauggaucuuggacacaugugcgacgcaacaauguccuacgaaugcccaaugcuggaugagggcguagaaccagacgacgucgacugcuggugcaacacgacaucgacgugggucguauacggaacaugccaccacaagaagggggaagcacgaagaucgcggagagcaguaacacucccgagucacucgacacggaagcuacaaacaaggagccaaacauggcuggaguccagagaauacacaaagcaccuaauaaaagucgaaaacuggaucuuccgcaaccccgguuuugcccuagucgcagucgcaauagccuggcuacuaggcucaagcaccagccagaaaguaauauaucuagugaugauacuccugauagcgccagcguacagcauuaggugcauaggaguaagcaaccgcgacuucguagaaggcaugucgggcgggaccugggucgacgucguauuagaacacggaggcugcgucaccguaauggcacaggacaaaccaacaguagacaucgaacucguaaccaccacagucagcaacauggcggaggucagaagcuacuguuacgaggcaucuauaagugacauggccagugacagccgcuguccaacacaaggagaagcauaccuagacaaacaaucagacacacaauacgucugcaagagaacccuaguagaccggggaugggggaacgggugcggacuuuucggcaagggcucgcucguaacaugcgcaaaauucacgugcucgaagaaaaugacgggcaaaagcauccaaccagaaaaccucgaauacaggauaaugcuaucggugcacggcucacaacacucaggaaugauaguaaacgacaccggauaugaaacagacgaaaaccgggcaaagguagagguaacaccgaacagcccccgggcagaggcgacacuaggcggcuucggaagccuaggcuuagacugcgaaccaagaacaggccucgacuucucagaccucuacuaccuaaccaugaacaacaaacacuggcucguccacaaagagugguuccacgacauaccgcucccauggcacgcgggagccgacacaggaacaccgcacuggaacaacaaagaggcccuaguagaguucaaagacgcacacgcaaaaagacaaacaguaguagugcuaggcagccaagaaggcgccgugcacacagcccucgccggagcgcuggaagccgaaauggacggcgcgaaaggcaaacuguucuccggacaccuaaagugccggcucaaaauggacaagcugcgacucaagggcguaagcuacucccuguguacagcagccuucacauucacaaaagugccggccgagacccuacacgggaccgugacaguagaagugcaauacgccggaacagacggccccugcaagaucccgguacaaauggcagucgauaugcaaacacuaacacccgucgggagauugauaaccgcaaaccccguaauaacagaaaguacagagaacaguaaaaugaugcuagaacuggacccgcccuucggcgacagcuacauagucaucggcgucggagauaagaaaaucacacaccacuggcaccgaagcgggagcacaauagggaaagcguucgaggcaacagucaggggagcgaaacggauggccguacuaggcgauaccgcgugggacuucggaagugucggcggcguauucaacucacuagggaaaggaauccaccaaaucuucggagcagccuucaagagccuauucggcggcaugaguugguucucacaaauacugauaggcacacugcugguauggcuagggcuaaauaccaaaaacgggagcauaagccuaaccugccucgcacucgguggcgugaugaucuuccugagcacagccguaagcgcggacguagggugcagcguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5057 - RNA, 2341 nt, Artificial Sequence
  DQ859059.1 prME-long mRNA Design 1 opt
gggagaaagcuuaccaugagaaucaucaacgccaggaaagagcgaaaacgucguggagcagacacaucgauaggcauagucggccuacugcucacaaccgcaauggccgcagagauaacacgcagaggcucagcauacuacauguaccucgaccgaagugacgccggaaaagcaaucucauucgcaacaacacuaggcguaaacaaaugccacguacaaauuauggaccuaggucacaugugcgacgccaccaugucauacgagugcccgaugcuagacgaaggcguggaaccagacgacguagacugcuggugcaacacaacgagcaccugggucguauacgggacgugccaccacaagaaaggcgaagcaagacgaagccggcgcgccgugacacucccaagccacagcacccgaaaacuacagaccagaagccagacuuggcuagaaagccgagaauacaccaaacaccucaucaaaguagaaaacuggaucuucagaaacccaggguucacgcucguagccguagccauagccuggcucuuaggcucaagcacgucgcaaaaagucaucuaccuagugaugauacuccugauagcgcccgccuacagcauacgaugcaucggagucagcaaccgcgacuucguggagggcaugucaggagggaccugggucgacguaguccuggaacacggaggcuguguaacaguaauggcccaggacaaaccaacagucgacaucgaacucguaaccaccaccguguccaacauggcagaagucagaucuuacugcuacgaagccagcaucucagacauggccucagacucacgcugucccacacaaggagaagcguacuuagacaaacaaucagacacccaauacguaugcaaacgcacgcucgucgaucgagguuggggaaacggcugcggacuauucggcaaaggcucgcucguaaccugugcaaaauucacaugcagcaagaaaaugacaggcaaaagcauccaaccggaaaaccuagaauaccggaucaugcucucgguacacggcucccaacacagcggaaugauagucaacgacgagaaccgcgcaaaaguagaagucaccccaaacucuccccgcgcagaagcaacccuaggaggguucggaucccuaggcuuggacugcgaacccagaacaggacucgacuucagcgaccucuacuaccuaacaaugaacaacaagcacugguugguucacaaagaaugguuccacgacaucccucucccauggcaugcgggggcagacacagggacgccucacuggaacaacaaagaagcccuagucgaguucaaagacgcgcacgcaaaacgccaaacggucguaguacucggcagccaagaaggcgcgguccacaccgcgcuagccggcgcucucgaagcggaaauggacggagcaaaaggacgccuauucuccggccaccucaagugccgacuaaagauggacaaacuacgauugaaagggguauccuauucccucugcacagcagcauucaccuucaccaagguccccgccgaaacccuacacggcaccgucaccgucgaagugcaauacgcaggaaccgacggcccgugcaaaguccccgcacaaauggccgucgauaugcagacacuaacaccgguaggacgacugaucacugcgaaccccgugaucaccgaaagcaccgaaaacucaaaaaugaugcucgaacuagacccuccguucggcgacagcuacaucgucaucggggucggcgacaagaaaauaacccaccacuggcaccgcagcggaucaacuaucggcaaagcguucgaggccaccguaagaggcgccaaacggauggcaguacuaggcgauacagcaugggauuucggguccguaggaggcgucuucaacagccucggaaaaggcauccaccaaauauucggcgccgcguucaagagccuauuuggcggaaugagcugguucucacaaauccugaucggaacucuccuagucuggcuaggacuaaacacgaaaaauggaucaauaagccuaacaugccuggcacuaggaggcgucaugauauuccuaaguacagcagucagcgccgacgucggaugcagcguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5058 - RNA, 2359 nt, Artificial Sequence
  KX377335.1 prME-long mRNA Design 1 opt
gggagaaagcuuaccaugcgcaucauaaacgcgagaaaagaacgaaaacgccgcggggcggacacgagcaucggcauaaucggacuguugcuaacgaccgcgauggccgcggagaucacaagacgaggcagcgcguacuauauguaccucgaccgguccgacgccggaaaagccaucucguucgccaccacccuaggagucaacaaaugccacguccaaauaauggaccucggccacaugugcgaugccacaaugucauacgagugccccaugcuagacgaagguguagaaccagacgacguagacugcuggugcaauaccacgagcacguggguaguuuacggcacgugucacagaaagaaaggagaagccaggagaucaagacgcgcggucacccucccaagccacucaacacgcaaauuacagaccagaagccagaccuggcucgaguccagagaauacaccaaacaccugauaaaagucgaaaacuggaucuuucgcaaccccggauucgcacucguggcaguagcgauagcauggcuccuaggcagcagcacaucccaaaaagugauuuaucucgucaugauccuacugauagcaccggcguacagcaucaggugcauaggaguaaguaacagggauuuuguagaaggcaugucuggcggaacguggguagacgucguacucgagcacggaggcugugucacagucauggcccaagacaaacccacagucgacaucgagcucgucaccacgacagucagcaacauggcagaagugcgaucauacugcuacgaagcgucgaucagcgacauggcauccgacucgcgcugccccacgcaaggugaagcauaccuagacaagcaaucagacacacaauaugucugcaaacgcacccucgucgaccgaggauggggcaacggaugcggacucuuuggaaaaggaucccuaguaaccugcgccaaauuuaccugcagcaaaaagaugacgggcaagagcauccaacccgaaaaccucgaguacagaaucaugcuguccguccacggcucgcaacacucaggaaugauagucaacgacacaggcuacgaaacagaugaaaacagggcaaaagucgaagucacccccaacuccccacgcgcggaagccacccugggcggauucggcucccuaggccuagacugcgaaccacgcacaggacucgacuucagcgaccuguacuaccuaacaaugaacaacaaacacuggcuaguccacaaggagugguuccacgacauaccacuccccuggcacgcaggcgccgacaccggaaccccgcacuggaacaacaaagaagcacucgucgaguucaaagacgcacacgcaaagagacaaacgguaguaguccugggaucccaagaaggcgcaguacacacagcacuggccggcgcccuagaagccgaaauggacggcgcgaaaggaaaacuguucagcggccaccucaaaugccgccuaaaaauggacaaacuacgacucaaaggaguaucuuacucccuauguaccgcagccuucaccuucaccaaaguaccggccgaaacgcuccacggaacugugacagucgagguacaauacgccggcaccgacggacccugcaaaauaccaguacaaauggccguagacaugcaaacgcuaacgcccguaggacggcuaaucacagcgaaccccgugauaacagaaucaaccgagaacucaaaaaugaugcucgaacuagacccgcccuucggcgacagcuauauagugauaggcguaggcgacaagaaaauaacccaccacuggcacagaagcggauccaccaucggcaaagcguucgaagcaaccguaaggggcgccaaaagaauggcaguccuaggagauaccgccugggacuucggaagcgucggaggagucuucaacagccuuggaaaagggauucaccaaaucuucggagccgccuucaaaagccuauucgggggcauguccugguucagccaaauacuaaucggcacccuauuagucuggcucggccucaauaccaaaaauggcagcauuagccuaaccugccuagcacucggaggcgucaugaucuuccugagcacagccguaagcgccgacguaggcugcuccguagacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5059 - RNA, 2359 nt, Artificial Sequence
  LC002520.1 prME-long mRNA Design 1 opt
gggagaaagcuuaccaugcgcauaaucaacgccagaaaagaacggaaacgacgaggcgcggacacaucaauaggaaucauaggacugcugcugacaacagcgauggcggccgagauaacaagacgaggcucggccuacuacauguaccucgaccggagcgacgcagggaaagcgauaucauucgcaacgacacucggaguaaacaagugccacguacaaaucauggaccucggacacaugugcgacgccacgaugucauacgagugccccaugcuggacgagggcgucgaaccagacgacguagacugcuggugcaacaccacaagcacauggguaguauacggaaccugccaccacaagaaaggcgaagcgcgaaggucaagacgagcagucacccuaccaagccacagcacaagaaaacuccaaacccgcucacaaaccuggcuagaaagccgagaauauaccaaacaccucaucaaaguagaaaacuggauauuccgcaacccaggcuucgcacucguggcaguagccauagcaugguuauuaggcaguagcacuagccaaaagguaaucuaccuagucaugauacuccuaaucgcgcccgcguacucaaucagaugcaucggaguaagcaacagagacuucguagaagggaugucagggggaacauggguagacgucguacuagaacacggaggaugcgucacgguaauggcccaggacaagccaaccgucgacauagagcucgugaccacuaccguaagcaacauggcggaaguacgaucauauugcuacgaagccucaauaucagacauggccucugacagccgcugcccaacacaaggagaagcguaccuagacaagcaaagcgacacgcaauacgucugcaaacggacacucguagaccgcggauggggaaacggcugcggucuauucggaaagggcucgcucguaaccugcgcaaaauuuaccugcucaaagaaaaugacaggcaaaucaauucagccggaaaaccucgaguacaggaucaugcucuccguacacggcucacaacauagcggcaugacagucaacgacauaggauacgaaacugacgaaaacagggccaaagucgaaguaacgcccaacagcccaagagcagaagccacacugggaggauucggcagcuuaggccuggacugcgaaccgcgaaccggauuggacuucucagaccucuacuaccuaaccaugaacaacaaacacuggcuaguccacaaagaaugguuccacgacauaccacuaccguggcacgcaggcgcagacaccgggaccccgcacuggaacaacaaagaagcgcuggucgaguucaaagacgcgcaugccaaacgacaaaccgucguggucuuaggaucccaagaaggcgcgguccacacggcacuggcaggcgcucucgaagccgaaauggacggagcaaaaggaaagcuauucagcggccaccucaaaugcagacucaaaauggauaaacugaggcucaaagggguaucguacucccugugcacagcagccuucaccuucacaaaaguccccgcagagacccuccacggcacagugacaguggaaguccaauacgccgggacagacggaccaugcaaaaucccaguccagauggcaguagauaugcaaacacugacacccguaggaagacuaaucacggcaaaccccgugauaacagaaucgacagaaaacuccaaaaugaugcuggaauuagacccacccuucggcgauagcuacaucguaauaggagucggggacaagaaaauaacacaccacuggcaccgcagcggaagcaccaucggcaaagcauucgaggcgacggucagaggcgcaaaacgaauggcggucuuaggagacacagcaugggacuucggguccgugggagggguguucaacucacuaggaaaaggaauccaucaaaucuucggagccgcauucaaaagccuauucggagggauguccugguucucacaaauacuaauaggcacacugcugguauggcuaggacucaacaccaaaaacgggagcauaagccuaaccugccucgcacuagggggaguuaugaucuucuugagcacggccgucagcgcagacgucggcugcucaguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5060 - RNA, 2347 nt, Artificial Sequence
  KU963573.2 prME-long mRNA Design 1 opt
gggagaaagcuuaccaugcgcauaaucaacgcccgcaaagaacgcaaacgaagaggcgcagacacaagcauaggcaucaucggccuccuccucacaaccgccauggcagcagaaauaacccgcagaggaagcgccuacuacauguaccuagaccgcuccgacgcaggcaaagccauaucauucgcaacaacccugggaguaaacaaaugccacguccaaauaauggaccugggccacaugugcgacgccacgauguccuacgaaugcccaauguuagacgaaggaguagaacccgacgacgucgacugcugguguaacacaacuagcacauggguagucuauggaaccugccaccacaagaaaggagaagcaagacgaucccgccgcgcggugacccugccaagccacucaacacgaaaacuacaaaccagaucccaaaccuggcucgaaucacgugaauacaccaaacaccucauaaaggucgagaauuggauauuccgaaacccaggcuucgcccuaguagcaguagcaauagcauggcugcucgggaguagcaccagccaaaaggucaucuaccuagucaugauacuacucauagccccagcauacagcauccgaugcauaggaguauccaaccgcgacuucguagaagggaugagcggaggcaccuggguagacguaguccucgaacauggaggaugcguaacgguaauggcacaggacaagcccacggucgacauagaauuagugacgaccacaguauccaacauggccgagguacgaaguuacugcuacgaagcgucaauauccgacauggcgagugacucgcgcugccccacacaaggggaggcuuaccucgacaaacagagcgacacacaauacgucugcaaacgaacccuagucgaccgcggaugggguaacggcugcggacuauuuggcaaaggcagccuagugaccugcgccaaauucacauguuccaaaaagaugacuggaaaauccauacaaccagaaaaccucgaauaccgcaucaugcuauccguacacggcucacaacauucaggcaugauaggguacgaaacagacgaaaaccgcgccaaaguagaagucacaccaaacagcccaagagcagaggccacacuaggaggcuucggaucccucggacucgacugcgagccgcgaaccggccucgacuucucggaccuauacuaccucacaaugaacaacaaacacuggcucguccacaaagaaugguuccacgacaucccccugccauggcacgcaggcgcagacaccggaacaccgcacuggaacaacaaagaagcacugguagaguucaaagacgcccaugccaaacgccaaacaguaguaguucugggaucccaagaaggcgcaguccacacugcccucgcgggcgcccucgaagcagaaauggacggcgcuaaaggcaaacuauucuccgggcaccucaaaugucgacuaaaaauggacaaacuccgacuaaaaggcguaagcuacucucucugcaccgccgcguucacguucacaaaaguccccgccgaaacacuccacggcacagucaccgucgaaguccaauacgccggaaccgacggacccugcaaaauacccgugcagauggcaguagacaugcaaaccuuaacaccagucggacgccucauaaccgcaaacccagucaucacagaaagcaccgaaaacuccaaaaugaugcuagaacucgacccgcccuucggcgacuccuacaucgugauaggcgugggggacaagaaaaucacacaccacuggcaccgaagcggcagcacaaucggaaaagccuucgaggccacagucagaggcgcaaaaagaauggccgugcuaggagacaccgcaugggacuucgguuccguaggcggcguauucaacagccucggcaagggaauccaccaaaucuucggcgcggcuuucaaaagccucuucggcggcauguccugguucucacagauccugaucggcacacuccucgucuggcuaggccuaaacaccaaaaacggcucgauaaguuuaacaugccucgcacugggcggagucaugaucuuccucucaaccgcaguuagcgccgacguaggaugcagcguagauuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5061 - RNA, 2359 nt, Artificial Sequence
  KX694534.2 prME-long mRNA Design 1 opt
gggagaaagcuuaccaugagaaucaucaacgcacgaaaggaaaagaaacgcagaggagcagacacaagcgucggcauaguaggacuccuacuaacaacagccauggccgcagaagucacaagaaggggaagcgcauauuacauguaccucgaccgcaacgacgcuggcgaagccaucagcuucccgaccacccuaggcaugaacaaaugcuauauacaaauaauggaccucggccauaugugcgacgcaacaaugagcuacgaaugccccaugcucgacgaaggcgucgaaccagacgacgucgacugcuggugcaacacaaccucaacaugggucgucuacggcacgugccaccacaaaaagggagaagccagacgcucccgacgagccguuacccucccuagccacagcacgagaaaacuccaaacacgaucacaaaccuggcuugaaagccgcgaauacaccaaacaccucauccgcguggaaaacuggauauuccgaaaucccggcuucgcccucgcagcagccgcgaucgcauggcuccuuggcuccuccacgucccagaaagucaucuaucucgucaugauccuacuuaucgcgccugcauacuccauaagaugcaucggcguaagcaacagagacuucgucgaaggcauguccggcggcaccugggucgacgucguccuagaacacggggguugcguaaccgucauggcucaggacaaaccaacagucgacaucgaacugguaacaacgaccgucagcaacauggccgaaguacgcagcuacugcuaugaggcuucaauaagcgacauggccagcgacagccggugcccaacacaaggagaagccuaccuagacaaacaaucagacacccaauacgucuguaagagaacccugguggaccgcggauggggaaacggcugcggauuguucggcaagggcucccuaguaacaugcgcaaaauucgccugcuccaagaaaaugaccggcaaaucgauccaacccgaaaaccucgaauaccgcauaaugcuauccguccacggcucacaacacucaggcaugauaguaaacgacaccggacacgaaacagacgaaaauagagcgaaaguggagaucacucccaacagcccaagagcggaagccacacuaggaggcuucggcucccuaggacucgacugugaaccacgaaccggacucgauuucucggaccucuacuaccuaacaaugaacaacaaacacuggcucgugcacaaagaaugguuccacgacauaccccucccuuggcacgcaggagcagacaccggcaccccacacuggaacaacaaagaagcccucguagaguucaaagacgcccacgccaaaagacaaacaguuguaguacugggcagccaagaaggagccgugcacaccgcccuagccggagcccuagaagccgaaauggacggggcuaaaggccguuuauccagcggccaccuaaaaugcagacuaaaaauggacaaacuaagguuaaaaggcguaagcuacucccuaugcacggcggcauucaccuucacaaaaauccccgcagaaacccuccacggaacagucacaguggaaguucaauacgccggcacagacggacccuguaagguaccagcacaaauggcugucgacaugcagacucugacaccaguugggcgacucaucaccgcaaaccccgucaucacugaaagcaccgaaaacuccaagaugaugcuagaacuugacccaccauucggagacagcuacauaguaauuggcgucggcgaaaagaaaaucacacaccacuggcacagaagcggcagcacgauagguaaagcauucgaagcaaccguaaggggcgccaaacgaauggcagugcucggagacaccgccugggacuucggaagcguaggaggcgcccugaacucacuaggccgaggcauacaucaaauauucggggcagcauucaaaagccucuucggcggcaugagcugguucagucaaauacuaauagggacacugcuaauguggcuaggacugaacaccaaaaacggcucaauaucacuaaugugccuagcacucggaggcgugcuaauauuccuaagcacagcagucucggcagacguaggaugcagcguagacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5062 - RNA, 2359 nt, Artificial Sequence
  KX447520.1 prME-long mRNA Design 1 opt
gggagaaagcuuaccaugcgcaucaucaacgcaaggaaggagaaaaagcgacgaggcgcagacgcgagcgucggcauaguaggccuccugcucacaaccgcgauggccgccgaggucacacgcagaggcucggccuauuacauguaccucgacagaaaugacgcaggcgaagccaucucauucccgaccacacucggaaugaacaaauguuacauacaaaucauggaccuagggcacaugugcgacgcaacuauguccuacgaaugcccgaugcucgacgaaggaguagaaccagacgacguagauugcuggugcaacacaacaagcacauggguagucuauggcacgugccaccacaaaaagggggaggcgaggaggagcagaagggcaguuacacucccaagccacagcacgcgcaaacuacaaacaaggagccagaccuggcuugaaagcagagaauacacaaagcaccugaucagggucgaaaacuggauauuccgcaacccggguuucgcacuagcagcagcagcaaucgcauggcuccuaggaagcagcacgucccaaaaaguaauauaccucguaaugauacugcucaucgccccagcuuauucaaucaggugcaucggcgugagcaacagagacuuuguggaaggaaugucaggcggcacgugggucgacgucguucuagaacacggaggaugcgucacaguaauggcucaggacaaaccaacagucgacauagagcuaguaacaacaaccguaagcaacauggcagaaguucgcaguuacugcuaugaagccucgaucucagacauggccucagacucgagaugccccacacaaggagaagcguaccuagacaaacaaucagacacccaauacguaugcaaaaggacccuaguagaccgcggaugggggaacgggugcggacuauucggaaagggaucgcucguaaccugcgcaaaauucgccugcagcaaaaagaugacuggcaaaagcauacaacccgaaaaccuggaauacagaaucaugcuaucaguccacgggagccaacacucaggcaugauaguaaacgacacgggccacgaaacagacgaaaacagagcuaaaguagagauaacacccaacagcccacgagcggaagcgacacuaggagguuucggaagccuaggccuggacugcgaaccgcgaacaggccucgauuucagcgaucucuacuaccugaccaugaauaacaaacacuggcucguacauaaagagugguuccacgacauaccgcuaccauggcaugccggagcagacaccggaacaccccacuggaacaacaaagaggcccuagucgaguucaaagacgcgcacgccaaaagacaaacaguggugguacugggaucgcaggagggcgcgguccacacugcacucgccggcgcgcuagaagccgagauggacggagcaaaaggacgccuaagcagcggacaccucaagugccgacuaaagauggacaagcuccgccuaaaaggggucucguacagucucugcacggcagcauucaccuucacgaagaucccggcggaaacacugcacggaaccguaacaguagaagugcaauacgccgggaccgacggcccgugcaaagucccggcccaaauggcaguagacaugcaaacgcuaacaccaguaggaagacugaucacugccaacccaguaaucacagaaucgacagagaacucaaaaaugaugcuagaauuggacccgcccuuuggcgacagcuacaucgugauaggaguaggggaaaagaaaauaacacaccacuggcaccgaagcggaagcacaaucgggaaagccuucgaggcaacaguccgaggcgcaaagagaauggcaguccuuggagacacggcaugggacuucggaagcgucgggggcgccuugaacucacuaggcaaagggauccaccaaauauucggagccgcguucaagagccucuucggcggcauguccugguuuucacaaauacucaucggaacauuacugauguggcucgggcuuaacaccaagaacggcucaauaagccugaugugccucgcccuagggggcguacucauauuccuguccacggccgucagcgccgacguaggaugcagcguagauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5063 - RNA, 2359 nt, Artificial Sequence
  KX369547.1 prME-long mRNA Design 1 opt
gggagaaagcuuaccaugcgaaucaucaaugcacggaaagagaaaaagcgccgaggggccgacacgagcgucgggaucguaggccuacugcugaccaccgcaauggccgcagaagucacacgacgaggcagcgcauacuacauguaccucgacagaaacgacgccggagaagccaucucauuccccacaacacucgggaugaacaaaugcuacauccaaauaauggaccuaggacacaugugcgaugcaaccaugagcuacgaaugcccaaugcucgaugaaggcguugaaccagacgacguggacugcuggugcaacacaacuagcaccugggucgucuacggcacaugccaccacaagaaaggggaggcacgcagaagucgacgggccguaaccuuacccagccacuccacaagaaaacuacaaacacgcucacaaaccuggcuggaaagucgagaauacaccaaacaccucauccgaguggaaaacuggaucuucagaaacccgggacuagcacuagccgccgcagcaaucgcauggcuacuaggaagcuccacaagccaaaaagucauauaccucgucaugauccuacugaucgccccagcauacaguauacgcugcauaggagugagcaacagagacuucguagaaggcaugucaggaggaacgugggucgacguaguccucgagcacggcggcugcguaaccguaauggcacaagacaaacccaccguagacauagaacucgucaccacaaccguuagcaacauggcagaggucaggucuuacugcuacgaagcaagcauaagcgacauggcauccgacucaagaugccccacccaaggcgaagcauaccuagacaaacaauccgacacacaauacguaugcaaacgaacccuaguagaccggggcuggggcaacggcugcggacuauucggcaaagggagccuagucacaugcgcaaaauucgcauguuccaagaaaaugaccggcaaauccauccaaccagagaaccucgaguaccgcauaaugcugucaguacacggcucccaacacuccggaaugauagugaacgacaccggccacgaaaccgacgagaacagagccaaagucgaaauaacacccaacucaccccgggcagaggcaacccucggaggcuucggcagucucggacucgacugcgaaccccguaccggucucgacuuuucagaccuauacuaccuuacuaugaacaacaaacacuggcuagugcacaaagagugguuccacgauaucccccuaccauggcacgccggggccgacaccggcacaccacacuggaacaacaaagaagcgcucgucgaguucaaagacgcgcacgcaaagcgccaaaccgugguaguccuaggcagccaagaaggggcaguccacacagcacuagccggagcgcuggaagcagaaauggacggagccaaaggccgccuauccagcggacaucuaaaaugcagacuaaaaauggacaaacuccgucucaaaggaguauccuacagccucugcacagcagcuuucaccuucacgaagauccccgccgaaacccuccacggcacagucacagucgaaguccaguaugccggaacagacggaccaugcaaagugccggcccaaauggccguggacaugcaaacacuuaccccaguaggccggcuaaucacagcaaacccagugaucaccgaaagcaccgaaaacuccaaaaugauguuagaacuggacccacccuucggcgauuccuacaucgucaucggcgugggcgaaaagaaaaucacacaccauuggcaccgaagcggcuccaccaucggaaaggcauucgaagccaccguaagaggcgccaagcgcauggcaguacuaggagacacagcgugggacuucggcagcgucggaggagcucuaaacagccugggaaaggguauacaccaaaucuucggagcggccuucaaaagccucuucgggggcaugucaugguucagccagauccuaaucggaacccuacuaauguggcucggccuaaacaccaagaacggaagcauaucgcugaugugcuuagcacucggcggaguacuuaucuuccucucaacagccguauccgccgacgucggcugcagcgucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5064 - RNA, 2359 nt, Artificial Sequence
  KX447515.1 prME-long mRNA Design 1 opt
gggagaaagcuuaccaugcggaucaucaacgcacgcaaagagaagaaacgacggggagccgacaccucaguaggcaucgugggacuacuucucacaacggcaauggcagccgaaguaacacgcagaggaagcgccuacuacauguaccuagaccgcaacgacgccggcgaagcaaucagcuuccccacaacccuaggaaugaacaaaugcuacauacaaauaauggaccucggccacaugugcgacgccacaaugucauacgaaugccccaugcuagacgaaggaguagaacccgacgacgucgacugcuggugcaacacgacaagcaccuggguuguauacggaaccugccaccacaagaaaggcgaagcacgccgcucacggagagccguaacccuccccucacacagcacaagaaaacugcaaacacggucgcaaaccuggcuagaaucacgcgaauacaccaaacacuuaauccgagucgaaaacuggauauuccgcaauccaggcuucgcacucgccgcagccgccaucgcauggcuacugggaagcuccacaagccaaaaaguuaucuaccucguaaugauccuacuaaucgcccccgcuuacucgauacggugcauaggaguaucgaacagggacuucguagagggcauguccggcggcacaugggucgacgucgucuuagagcacgggggcugcguaaccgucauggcucaagacaaaccgaccguggacaucgaacucguaaccacaaccgugagcaacauggccgaaguaagaagcuauuguuacgaagcaagcaucucagacauggcaagcgacagcagaugcccaacccagggagaagcauaccuagacaaacaaucagauacacaauacgugugcaaaaggacacucguagacagaggaugggggaacggaugcgggcuuuucggaaaaggaucacucgucacaugcgcaaaauucgcaugcagcaagaaaaugacaggcaaaucaauccaacccgagaaccuggaauacagaauaaugcuauccguccacgggagccaacacuccggaaugauaguaaacgacacaggacacgaaacugacgagaaccgagccaaagucgagaucacaccaaacagcccacgcgcggaagccacacucggcggauucggaucccucggccucgacugcgagccacgaaccggccuagacuucucggaccuauacuaccuaaccaugaacaacaaacacuggcuggugcacaaagaaugguuccaugacauaccgcuuccauggcacgcaggagcagacaccggcacaccccacuggaacaacaaagaagcgcuuguugaguucaaagacgcccacgccaaaagacaaaccguaguaguacucggcagccaagaaggugccguacacacagcgcuugccggcgcccucgaagcagaaauggacggcgcaaaaggacgccuuagcagcggccaccuaaaauguaggcucaaaauggacaaacuaagacuaaaaggggucuccuauucccuaugcacggcagcauucaccuucacgaaaauccccgcagaaacccuccacggaaccguaacagucgaaguacaguacgcaggaaccgacggaccgugcaaagucccagcccagauggcaguggacaugcaaacccugacgccagucggccgacucaucaccgccaacccugugaucacggagagcacagaaaacagcaaaaugaugcucgaacucgacccacccuucggcgacucguacauagucauaggcguaggcgaaaagaaaauaacacaccacugguaccgcuccggcagcacaaucgggaaagcauucgaagccacagucagaggggcgaaacgcauggccguacuaggagacacagccugggacuucggcagcguaggaggcgcacuaaacagccuagggaaaggcauacaccaaaucuucggagccgccuucaaaagccuauucgguggaauguccugguucucccaaauacuaauaggcacacuccuaauguggcucggacuaaacaccaaaaacggaucaaucucccuaaugugucucgcccuaggcggaguacucauauuucuauccacagcagucagcgcagacguaggguguucagucgacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5065 - RNA, 2359 nt, Artificial Sequence
  KU501217.1 prME-long mRNA Design 1 opt
gggagaaagcuuaccaugcgaaucauaaacgcccggaaagaaaagaaacgccgcggagccgacaccuccgucggaauaguaggccugcugcucaccacggccauggcugccgaagugacccgccgaggaagugccuacuacauguaccucgacagaaacgacgcaggcgaagcaaucagcuuccccacaacguuaggcaugaacaaaugcuauauacagauaauggaccugggccauaugugugaugcaaccaugucauacgaaugccccaugcucgacgaaggagucgaaccagacgacguagauugcuggugcaacacaaccucgacauggguagucuauggaacaugccaccacaagaaaggcgaagcccgccgcucaagacgagcgguaacgcuaccuucgcauuccacacgaaaacuacaaacccgcucccaaacauggcuagaaagccgagaauacacaaaacaccucaucaggguagagaacuggaucuuccgcaacccaggcuucgcacucgccgcagcagccaucgccuggcuacuaggaagcagcacaucgcaaaaaguuaucuaccucguaaugauccuccuuaucgccccggccuacagcauacgcugcaucggggucuccaacagagacuucgucgaaggcaugagugggggcacguggguagacgucguacuagaacacggcggaugcgugaccgucauggcacaagacaaacccaccguggacauagagcuaguaacaaccacuguaucgaacauggccgagaucagaagcuacugcuacgaagccuccauauccgacauggccagcgacagcagaugcccgacacaaggagaagccuaccucgacaaacaaagcgacacacaauaugucugcaaacgcacccuagucgacagaggcuggggcaacgggugcggccucuucggcaaaggaagccucgucacaugcgcgaaauucgcaugcuccaaaaagaugaccggaaaaucgauacaacccgagaaccucgaauaccgaaucaugcuaaguguccacggcagccaacacucaggaaugaucgucaaugacaccggacacgagacagacgaaaaccgagccaaaguagaaauaaccccaaacucaccacgggcagaggcgacgcuaggcggauucggcucccugggccucgacugcgaaccacggaccggacucgacuucagcgaccuauacuaccucacgaugaacaacaaacacuggcuaguacacaaagaaugguuccacgacaucccacugccauggcacgcaggcgcagauacaggcacaccccacuggaacaacaaagaggcccuaguagaguucaaagacgcacacgccaaaagacaaaccguagugguacucggcagccaagaaggcgcaguacacacagcacucgccggcgcacuggaagcagaaauggacggagccaaaggccggcuauccagcggccaccugaaaugccgccucaaaauggacaagcucaggcucaagggaguaagcuacagccuaugcaccgcagcauuuaccuucacaaaaauccccgcggaaacucugcacggcaccgucacagucgagguucaauacgcaggcaccgacggcccaugcaagguccccgcacaaauggcuguggacaugcaaacacucaccccugucggcagacucauaaccgccaacccagucauaaccgagagcacagaaaauuccaaaaugaugcuagaacuagacccucccuucggggacagcuacaucgucaucggcguaggggagaaaaagaucacccaccacuggcaccggucaggcucaaccauaggcaaagccuucgaagcaacaguaagaggagccaaacgcauggccguacugggagauacagccugggauuucggaucugucggaggcgcacuuaacagccuuggcaaaggcauccaccaaaucuucggcgccgccuucaagucccucuucggcggaaugagcugguucagccaaauccuaaucggcacccuccuaauguggcucggacucaacaccaaaaacgguuccaucucauuaaugugccuagcccucggagguguccucauauuccuauccaccgcagucuccgccgacguaggcuguagcgucgacuucucuaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5066 - RNA, 2359 nt, Artificial Sequence
  KU312314.1 prME-long mRNA Design 1 opt
gggagaaagcuuaccaugcgcaucaucaacgcaagaaaagaaaagaaacgcaggggagcagacaccucggucggcauagucggacuccuacucaccaccgccauggcugcugaaguuacacgcagaggaucggccuacuacauguaccuggaccgcaacgacgcaggggaggccauaucguuccccaccacacuuggaaugaacaaaugcuacauacaaaucauggaccucgggcacaugugcgacgcaaccauguccuacgaaugccccaugcucgacgaaggaguagaaccagacgaugucgacugcuggugcaacaccacgagcacaugggucguuuacggcacaugccaccacaagaaaggugaagcccgccgcagucgacgagccgucacccuuccaagccacuccacacgaaaacuccaaaccaggagccaaaccuggcucgaaagccgagaauacaccaaacaccucauaagaguagagaacuggauauuccgcaacccaggcuucgcccucgcagccgccgccaucgcguggcuccuaggcaguagcaccagccaaaaagugauauaccuagucaugauacuacugaucgcaccagcauacucaauccggugcauaggaguaucuaaccgagacuucguagaaggcaugucaggagggacauggguggacguaguccucgaacacggagggugcguaacaguaauggcccaagacaaacccaccgucgacaucgagcuagucaccacgaccgucagcaacauggcagaaguccgguccuacugcuacgaagcaagcaucucggacauggccagugacucccgcugccccacgcagggcgaagcauaccucgacaaacaauccgacacccaauacgucuguaaacgcacacucguagaccgcggcuggggaaacggcugcgggcuauucggaaagggcagcuuagucacaugcgccaaguuugcaugcucaaagaaaaugaccggcaaaagcauacaacccgaaaaccucgaauaccguaucaugcuguccguacacggaucacaacacagcggaaugaucgucaacgacaccggccacgaaacagacgaaaacagagcaaaagucgaaauaacucccaauagcccacgcgcagaggccacacugggcgguuucggcagccugggccuagacugcgaaccccgcacaggccucgacuuuuccgaccucuacuaccucaccaugaacaacaaacacuggcucguccacaaagaaugguuccaugacaucccccucccauggcacgccggcgccgacaccggaaccccacacuggaacaacaaagaagcccuagucgaguucaaagacgcccacgcgaaacgacaaaccguaguaguacucggcagccaagaaggcgcaguucauacggcccucgcgggagcacucgaagcugaaauggacggcgcaaaaggacgacucucaucaggacaucugaaaugccgacucaaaauggacaaauuaagacucaaaggcguauccuacucgcucugcacggcagcauucacguuuacaaaaauaccagcagaaacccugcacggcaccguuaccguagaaguccaauacgccgguaccgacggcccgugcaagguccuagcacaaauggcagucgacaugcaaacauugacacccgucggccgacugaucacagcaaaccccgugaucaccgaaucaaccgaaaacuccaaaaugaugcucgaacuggacccaccauucggcgauagcuauaucgucaucggagucggcgaaaagaaaaucacccaccacuggcaccgauccggcuccacaaucggaaaagcauucgaagcaacaguacggggcgcaaaacggauggcaguccucggcgacacagccugggacuucggcagcgucggcggcgcccucaacagccuaggcaaaggcauccaccaaauauucggugcagccuucaagagccucuucggaggaaugagcugguucagccaaauacucaucggcacacuccuaauguggcugggccucaacaccaaaaacggcagcauaagccucaugugucuggcccuaggaggaguacuaauauuccuauccacugccgucagcgcagacguuggcugcagcguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5067 - RNA, 2359 nt, Artificial Sequence
  KX446950.2 prME-long mRNA Design 1 opt
gggagaaagcuuaccaugcgcaucaucaacgcacgaaaggagaaaaaacgccgaggggccgauaccuccguuggcaucgugggacuccuccuaacuacagcuauggccgcggaagugacccgccgcggaagcgcuuacuacauguaccuagaucgcaacgacgccggcgaagccaucucauucccaacgacacugggcaugaacaaaugcuacauccaaaucauggaccuaggccacaugugcgacgccaccaugucuuacgaaugucccacacuugacgaaggcguagagcccgacgacguagacugcuggugcaacacgacgucaaccuggguuguauacggcacaugccaccacaaaaagggagaagccagacgcagcagaagagccgucacacuacccagccacucgaccagaaaacuacagacccgcagccaaacauggcuggaaucccgcgaauacacaaaacaccuaauacgcguagaaaacuggauauucaggaacccgggcuucgcccuagccgcagcagcaaucgccuggcuccuaggcuccuccacaucccaaaaagucauauaucucgucaugaucuuacucaucgccccagccuacucuauacgcugcaucggcgucuccaaccgcgacuucgucgaaggcauguccggaggaacauggguagacguaguacuggagcacgggggaugcgucacaguaauggcccaagacaaacccaccguagacauagaacuagucaccaccacagucucaaacauggccgaaguccgcucauacuguuacgaagcaagcauauccgacauggccuccgacucgcggugcccaacccaaggcgaggccuaccuagacaaacaaagcgacacccaauacgucugcaagcguacgcugguggaccguggauggggaaacggaugcggacuauucggcaaaggcagccucguuaccugcgcaaaauucgccugcuccaaaaaaaugacaggcaaaucgauucaacccgagaaccucgaauaccgaauaaugcuaagcguccacggaucacagcacuccggcaugaucgucaacgacaccggacacgagacagacgagaaccgcgcaaaaguggaaaucaccccgaacuccccccgugcagaggcaacccuaggcggcuucggcucacucggacucgacugugaacccagaaccggccucgacuucuccgacuuguacuaccucacaaugaacaacaaacacuggcuaguccacaaagaaugguuccacgacaucccccuccccuggcacgcaggagcggacaccggaaccccacacuggaacaacaaagaagcccucgucgaguucaaagaugcccacgcaaaacgccagacagucgucguccuaggaagccaagaaggagcaguacacacagcacucgcaggagcccuagaagccgaaauggacggugcaaaaggcagacucagcagcggacaucucaaaugcagacuuaaaauggacaaacuccggcucaaaggcgucagcuacagccucugcacagcagccuucacauucacaaaaauccccgcggaaacccuccacggcacuguaacggucgaaguccaauacgcaggaacggauggcccaugcaaagucccagcccaaauggcagucgacaugcaaacccucacccccgucggccgucucauaaccgcaaacccggucaucacagaaagcaccgaaaacagcaaaaugaugcuggaacuagacccacccuucggagauuccuacaucgucaucggcguaggcgaaaaaaaaauaacccaccacuggcacagaucagguucgacaaucggaaaagcguucgaagccaccguaagaggcgccaaacgcauggccguccucggagacaccgcaugggacuucggaucuguagguggagcccuuaacucccuaggcaaagguauccaccaaaucuuuggagcugcauucaaaucacuauucggcggaaugucaugguucagucaaauacucaucgggacccuacucauguggcuaggccuaaauaccaaaaacgggucgauaucacuaaugugccucgcacucggcggcguacucauauuucucucaaccgcgguaagcgcagacgugggaugcucagucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5068 - RNA, 2359 nt, Artificial Sequence
  KY003157.1 prME-long mRNA Design 1 opt
gggagaaagcuuaccaugcgaauaauaaaugcacgaaaggaaaagaaacgaagaggagcagacacauccguaggaauagugggacuacuacuaaccacggccauggcagcagaaguaaccaggaggggaucggccuacuacauguaccucgacagaaacgacgcaggagaagcaaucuccuuccccacaacacucggaaugaacaaaugcuacauccagauaauggaucuuggacacaugugcgacgccacaaugagcuacgagugccccauguuagacgaaggcguugaaccagacgacgucgauugcuggugcaacacaaccucaacuuggguagucuacgggacaugccaucacaagaaaggggaggcccgcagguccagacgagccguaacacuccccagccauucaacacgcaaacuccagacgcgcagccagaccuggcucgaaagccgagaauacacaaaacaccuaauccgcguagaaaacuggauuuuuagaaaccccggauucgcacucgcagcagcggcuauagccuggcuccucggauccagcaccagccaaaaaguaaucuaccucguaaugauccugcucaucgccccagcauacagcauccgaugcaucggagugagcaacagagacuucguagaaggcaugucaggcggcaccuggguagauguaguacucgaacacggaggaugcguaacgguaauggcccaagacaaaccaacaguggacaucgaacucgugaccaccaccgucuccaacauggcagaaguacggucauacugcuacgaagccucaaucagcgacauggcaagcgacuccagguguccgacccaaggcgaagcauaccucgacaaacaaagcgacacccaauacgucugcaaacggacccuaguagaccgaggcugggguaacggcugcggccucuuuggaaaaggaagccucguaacaugcgccaaauuugccugcagcaaaaagaugacagggaaaagcauacaaccagaaaaccuagaauacagaauaaugcucuccguccacggcagccaacacucaggcaugauaguaaacgacaccggacacgaaacggacgagaacagagccaaagucgaaauaaccccaaacagcccacgcgccgaagccacgcucgggggcuucggaucauugggauuagacugugaaccccgcacaggucucgauuucagcgaccucuauuaccucaccaugaacaacaagcacuggcugguacacaaagaaugguuccacgacauaccacuccccuggcacgccggugcagacaccggcacaccccacuggaauaauaaagaagcguuggucgaguucaaagaugcccacgcgaagagacaaaccguaguagugcucggcagccaagaaggagccguacacaccgcccucgccggcgcucucgaagccgaaauggacggagccaaaggucgccugagcuccggccaccuaaaaugccgacuaaaaauggacaaacuuagacuaaaaggaguaucauacucacucugcacggcagccuuuaccuucaccaaaaucccggcagaaaccuuacacggaacaguaacagucgaagugcaauacgcaggcacagacggccccugcaaaguccccgcacagauggccguagacaugcagacccucaccccggucggacgccucaucacagcuaacccggugaucaccgaauccaccgaaaacagcaaaaugaugcucgaacuugacccacccuucggcgacagcuacaucgucaucggagugggagaaaagaaaaucacgcaucacuggcaccguagcggaucaacgauaggaaaggccuucgaggccacgguaagaggcgcgaaaagaauggcaguccuaggagacacagccugggauuucgggucggucgguggcgcacucaacucacuaggcaaaggcauccaucaaaucuucggcgccgccuucaaaagccuauucggaggaaugagcugguuuagccaaauacuuauaggcacacuccuaauguggcucggacucaauacaaagaacggaagcaucucacuaaugugucuagcccuaggcgggguccucauauuccuauccacagucgucagcgccgacgucggcugcagcguugacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5069 - RNA, 2359 nt, Artificial Sequence
  KX811222.1 prME-long mRNA Design 1 opt
gggagaaagcuuaccaugagaaucaucaaugccagaaaagaaaagaaacggcgcggagccgacacauccgucgggauaguaggacuccugcucacaaccgcaauggcagcggaggucacucgacggggcucagcguacuacauguaccucgacagaaacgacgcaggagaagcaauaucauuccccacaacacuaggaaugaacaaaugcuauauccagauaauggaccuaggccacaugugcgacgcgacaaugagcuacgaguguccaaugcucgacgaaggaguagaacccgacgacguagacugcuggugcaacaccaccuccgcauggguaguguacggaacaugccaccacaagaaaggcgaagccagacgcucgcgcagagccgucacccuacccagccacuccacccgaaaacuucaaacccgcccacaaacauggcuagaaucacgggaauacaccaaacaccuaauacgcguugaaaauuggauauucagaaaccccggauucgcacuagcugccgcugccauagccuggcuacuagggaguucaacaucacaaaaagucaucuaccuagucaugaucuuacucaucgcacccgccuacagcauccgcuguauaggagucagcaaucgagacuuuguagagggaaugagcgggggcaccuggguagacgucguccuagaacacggcggaugcguaaccgucauggcgcaagacaaaccaaccgucgacaucgaacucgucacaacaaccgucucaaacauggccgaaguucgaucauacugcuacgaagcgaguauaucagacauggccagcgacucccggugccccacccaaggugaagcauaccuggacaaacaaagcgacacccaguacgucugcaaaaggacccugguggaccgcggauggggcaacggcugcggacucuucggcaaaggcagccucguuacgugcgcuaaauucgccugcagcaagaaaaugacaggcaaauccauccaacccgaaaaccuagaauaccgaaucaugcuaagcguacacggcucgcaacacucaggcaugauagucaacgacaccgggcacgaaaccgacgaaaaccgagccaaaguagaaaucacgccaaacucaccccgagccgaggccacacucggcggcuucggaucccucggccuagacugcgaacccagaacaggucucgacuucuccgaccuauacuaccugacaaugaauaauaaacacuggcucguccacaaagagugguuccacgauaucccacugcccuggcaugccggcgcggacaccggcacaccccacuggaacaacaaagaagcccuaguagaguucaaagacgcacacgccaaaaggcaaaccgucgucguccuaggaucccaagaaggcgccguccacaccgcccucgccggcgcccuagaagcagaaauggacggagccaaaggccgccucucaucaggccaccucaagugccgccuaaaaauggacaagcuacgacuaaaaggcgugagcuacucccucugcacagcggccuucaccuucacgaagauaccagccgaaacacuccacgggaccgucaccguagagguacaauacgcaggaacagacgggcccugcaaaguacccgcccaaauggccguagacaugcaaacccucaccccaguaggacgacucauaaccgccaacccagucauaaccgagagcaccgaaaacagcaaaaugaugcuagaacuagacccacccuucggcgauaguuacauuguaauaggcguaggcgaaaagaaaaucacacaccauuggcacagauccggaucaaccauuggcaaagcauucgaagcaaccguacgcggcgcuaaacgcauggccguacucggcgauaccgcaugggacuuuggauccgucgggggagcauuaaacucacuaggaaaaggcauccaccagauauucggcgccgcauucaaaucacucuucggaggaaugucaugguuuagccaaauacucauaggcacacuccucauguggcuaggccucaacaccaaaaacggaagcauaucccuuaugugccucgcccucggcgguguucucaucuuucuauccacagccgucagcgccgacgucggcugcucagucgacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5070 - RNA, 2359 nt, Artificial Sequence
  KX447516.1 prME-long mRNA Design 1 opt
gggagaaagcuuaccaugcgcaucaucaacgcccgcaaagaaaagaaacgacgcggcgcugacaccuccguaggcauaguaggacuccuacucaccaccgcaauggcagcagaagucacccgccgaggcagcgcauacuacauguaccucgacagaaacgacgccggugaagccauaucauuccccaccacccucggaaugaacaagugcuacauccaaauaauggaccuuggccacaugugcgacgccaccaugagcuacgaaugcccaaugcucgacgaaggaguagagccagacgacgucgacugcuggugcaacacgaccuccacuugggucgucuauggcacgugccaccacaagaaaggagaagccagaagaucacgccgugcaguaacgcuaccgagccacucaacccgaaaacuucaaacccguagccagaccuggcuagagucacgcgaauacacuaaacaccugauccgcguagaaaacuggauauuucgcaaccccggcuucgcgcucgcagccgcggcaauagccuggcugcuaggaucguccaccuccaaaaagguuauauaccucguaaugauccuccucauagcucccgcauacucaauaaggugcauaggcgucagcaaccgcgacuucgucgaaggcauguccggaggcaccuggguagacgugguccucgaacacggaggaugcgucacagugauggcacaagacaaacccaccgucgacauagaacucgucaccacuacagucagcaacauggccgaagucagaucauacugcuacgaagcaagcaucagcgacauggcauccgacucgcgcugccccacccaaggcgaagcauaccuagacaaacaaagcgacacccaguacguaugcaaacgcacacucgucgaccggggcugggggaacggcugcggucucuucggaaaaggcucccucguaaccugcgccaaauucgcaugcuccaagaaaaugaccggcaaaagcauccaacccgaaaaccucgaauaccgaaucaugcuaucgguccacgguucccaacacagcggaaugauagucaacgacaccggacacgaaaccgacgaaaaccgagccaaagucgaaauaacacccaacagcccgcgagcagaagccacacuaggcggauucggaagccucggccuagacugcgagccccgcacaggauuagacuuuuccgacuuauacuaccuaacgaugaacaacaaacacuggcucguccacaaagaaugguuccacgacauaccacuaccauggcacgcaggggccgacaccggaacaccacacuggaacaauaaagaggcacucguagaauuuaaagacgcacacgcaaaacgacagaccguugucguacucggaucccaggagggagccguccacaccgcacuagccggugcccuagaagcagaaauggacggagcaaaaggaagacuaaguagugggcaccucaaaugccgucuaaaaauggacaagcucaggcuaaaaggcgugagcuacucccucuguacagccgccuucaccuucaccaaaauccccgcugaaacacuacacggaaccgucaccgucgaaguccaauacgccggcaccgacggccccugcaaaguucccgcccagauggccgucgacaugcaaacccucacacccgucggucgacucaucacagcgaaccccgugauaaccgaaagcacugaaaauagcaaaaugaugcucgagcuggacccacccuuuggggacagcuacauaguaaucggcgucggcgaaaagaaaaucacccaccacuggcacagaagcgggagcaccauaggaaaagcauucgaagcaacaguccgcggugcaaaacguauggccguacucggagacacagccugggacuucggcagcguaggcggugcacuaaacagccuaggaaaaggaauacaccaaauauucggagccgccuucaaaagccucuucggaggcaugucgugguucucgcagauucucauaggcacacuucuaauguggcuaggccuaaacaccaagaacggcucaaucagccuaaugugccuggcacucggaggcguccuaaucuuccuaucaacagcagucagcgcagacgucggaugcagcguagacuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5071 - RNA, 2359 nt, Artificial Sequence
  KX520666.1 prME-long mRNA Design 1 opt
gggagaaagcuuaccaugagaaucaucaacgcacgaaaagaaaagaaacgacgcggagccgacacauccguaggcaucguuggacuacuauuaaccacagcaauggccgccgaaguaacaagaagagguagcgcauacuacauguaucuugaccggaacgacgccggcgaagccaucagcuucccgaccacacuagggaugaacaaaugcuacauucaaauaauggaccugggccauaugugcgacgcaacaaugucauacgaaugcccgaugcucgacgagggcguagaaccggacgacgucgauugcuggugcaacacaacuucaacuugggucgucuacgguaccugccaccacaagaaaggcgaagcccgccgcucgcggcgcgcaguaacgcuacccagccacuccacgcgcaaacuacaaacccgcucccagaccuggcuagaaucgcgagaguacacaaaacaccuaauccgcguggaaaacuggauuuuccgaaacccaggcuucgcccucgcagccgcagcgaucgcauggcuccuaggcaguagcacacgacaaaaaguaauauaucuuguaaugauacuucucaucgcccccgccuacagcauccgaugcauuggcgucagcaacagggacuucguagaaggcauguccggaggaaccuggguagacgucguucucgaacacggcggcugcgucaccguaauggcacaagauaaaccgaccguagacaucgaacuugugaccaccacgguguccaacauggccgaaguaagaagcuacugcuaugaagcaagcaucagcgacauggccagcgacagcagaugccccacacaaggcgaggcuuaccucgauaaacaaucagacacccaguacguaugcaagcgaacccuagucgacagaggcuggggaaacggcugcggccucuucgguaaagggucacucguuaccugcgccaaauucgccugcagcaagaaaaugaccggcaagagcauccaacccgaaaaccucgaauaccgaaucaugcugucaguccacgguagccaacacucagguaugauagucaacgacaccggacacgaaacagacgaaaacagagcaaaagucgaaaucacacccaacagcccuagagcggaagccacccucggaggcuucggcagccuaggccuagacugugaaccacgcacaggccucgacuucagcgacuuauauuaucucacaaugaacaacaagcacuggcuaguccacaaagaaugguuccacgacauaccacuacccuggcacgcaggagcagacaccggcacaccccacuggaacaacaaagaggcacucguugaauuuaaagacgcacacgccaaacgacaaaccgucguaguacuaggaagccaagaaggcgcaguacacacagcccuagccggggcgcuagaagccgaaauggacggcgccaagggacgccucuccuccggacaccucaaaugucggcuaaaaauggacaaacuaagacuaaaagggguauccuacagccucugcacggcagccuucaccuuuaccaaaaucccagccgaaacccuacacgggacagucacaguagaaguucaauacgccgggaccgacggaccaugcaagguccccgcgcaaauggccguggacaugcaaacccuaacaccuguaggccgacucauaaccgccaaccccguaauaaccgaaagcaccgaaaacuccaaaaugaugcucgaauuagaucccccauucggcgacagcuacauaguaauaggcguaggcgagaaaaagaucacgcaccacuggcacagauccggcagcaccaucggaaaagccuucgaggcaaccgugcgaggcgccaaacgcauggccguccucggagacacggcaugggacuucggaucaguaggcggagcccuaaacagccuaggaaaaggaauacaccaaauauucggcgcagccuucaaauccuuauucggcggcaugagcugguucucacaaauacuaaucgggacccugcucauguggcucggacucaacaccaaaaacggaagcauaucccucaugugccucgcacucgggggcguacuaaucuuccugagcacagcaguauccgccgacguagguugcucggucgacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5072 - RNA, 2359 nt, Artificial Sequence
  KU729218.1 prME-long mRNA Design 1 opt
gggagaaagcuuaccaugcgcauaaucaacgcgcgaaaagaaaagaagcgaagaucggcagacaccagcgucggcauagucggccuacuccucaccaccgcgauggccgcagaagucacacgcaggggcuccgcauacuacauguaccucgaccgaaacgacgccggcgaagccaucaguuuccccacaacacuaggaaugaacaaaugcuacauacaaaucauggaccuggggcacaugugcgacgccacaauguccuacgaaugccccaugcuggacgaaggcguggaaccggacgacguagacuguuggugcaauaccaccagcaccuggguaguguauggcacaugccaccacaagaaaggagaagccagacgcucacggcgcgcagugacacucccaagccacagcacucguaaacuacaaacccgaagccaaaccuggcuagaaucccgagaauauacaaaacaccucauaagaguagaaaacuggauauuccgaaaccccggauucgcgcucgcagccgcagcaauagcauggcuacuuggcucaagcaccagccaaaaagucauauaccuagucaugauacugcucaucgccccagcauacucaaucagaugcauaggcguaagcaaccgagacuucguugaagggaugucuggagggacaugggucgacgucguacuagaacacggaggcugcgucacggucauggcccaggacaaaccaacgguagauauagagcucguaacgacaaccguaagcaacauggcagaaguacgcaguuacugcuacgaagccagcauaucagauauggccuccgacucccgcugccccacacagggagaggccuaccucgacaaacaaucagacacacaauacgucugcaaacggacgcuaguagaccgcggcuggggaaauggaugcggucucuucggcaaaggaucgcuagugacaugugccaaauucgcaugcuccaagaaaaugacaggcaaauccauccaaccagaaaaccuagaguacagaauaaugcucagcguacacggcagccaacacagcggcaugauagucaaugacacaggacacgaaaccgacgaaaaccgggccaagguagagauaacccccaacagcccaagagcagaggcgacccugggcgguuucggcagccucggccuagacugcgagccaagaacaggacucgacuucagcgaccucuacuaccuaacaaugaacaacaaacacuggcuaguacacaaagaaugguuccacgacauaccacuaccauggcacgccggcgcagacaccgggacaccacacuggaacaacaaggaagcccuagucgaguucaaggacgcacacgcaaaacgacagaccgucguaguacuaggaucacaagaaggggccguacacacagcccuagccggugcacuagaagcagaaauggacggagcaaaaggacgccuaucaagcggccaccuaaaaugccgccucaaaauggauaaacuucgucuaaaaggagucagcuacagcuuaugcacugcagcauucacauucacaaaaaucccagcagaaacacuacacggaaccgucacaguggaaguccaauacgccggaacagacggcccaugcaaaguaccagcccaaauggcggucgauacccagacacucaccccagucgggcgacucauaacagcaaacccagucaucaccgaaucgacagaaaacucaaaaaugaugcuagaacucgacccacccuucggcgacagcuauaucguaauagggguaggagagaaaaagauaacacaccacuggcaccggagcggcagcaccauaggcaaagcguucgaagccacaguccguggagcaaaaagaauggcaguauugggggauacggccugggacuucggcagcguaggaggagcccucaacagccuaggaaaagggauccaccaaauauucggcgccgcguucaaaagccuguucggaggaaugagcugguucucccaaauacuaaucgggacccuccucauguggcucggacuuaacaccaaaaacggaagcaucucacuaaugugccuagcacuaggaggagugcuaauuuuccugaguacagccguauccgcggacgucggcugcuccguugacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5073 - RNA, 2359 nt, Artificial Sequence
  KU761561.1 prME-long mRNA Design 1 opt
gggagaaagcuuaccaugagaaucaucaacgcaagaaaagaaaagaaaagacgaggagccgacacaaacguaggaaucgucggacuacuccucacaacugcaauggcagcagaagucacgcgacgaggauccgccuacuacauguaccuagaccgcaacgacgcgggcgaagcaauaucauucccaaccacccuggggaugaacaaaugcuacauacagauaauggaccucggacacaugugcgacgcgaccaugagcuacgagugcccaaugcucgacgaaggcguggaaccagacgaugucgacugcuggugcaacaccacgagcacaugggucguauacgggacaugccaccacaagaaaggagaagcgaggcgaucccggagagccgucacccucccgagccacucaacacgaaaacuacaaacaagaucgcaaaccuggcuagaaucgagagaauauaccaaacaccuaauaaggguagaaaacuggaucuuccgcaacccgggcuucgcgcuagccgcagccgcaauagccuggcugcuagggagcucaacaagccagaaaguaaucuaucuaguaaugauccuccuaauagccccagcauacagcauccgcugcauaggcguaagcaacagggauuucguagaaggaaugagcggaggcacauggguagacguagugcucgagcauggaggaugcgucacagucauggcacaagacaaaccaacagucgacauagaacugguaacaaccacaguguccaacauggcagaaguccgcagcuacugcuacgaagccagcauaagcgacauggcaagcgacagccggugcccaacacaaggagaagccuaccuagacaaacaauccgacacacaauacguuugcaaacgcacguuaguagaccgcggauggggaaacgguugcggacucuucggcaaagguagcuuggugacaugcgccaaauucgccugcaguaagaaaaugacaggcaaaagcauccaaccagagaaccuagaguacagaaucaugcucagcguccacggcucccaacacaguggaaugaucguaaacgacacaggacacgagacggacgaaaacagagcaaaaguagaaaucacacccaacagcccacgggcagaagccaccuugggaggauucggaucccuaggucucgacugcgaacccagaaccggauuagauuucuccgaccucuacuaccuaaccaugaacaacaaacacuggcucguccacaaagaaugguuccacgacaucccauuaccauggcacgccggugccgacacaggaaccccgcacuggaacaacaaagaagcccuaguggaguucaaagacgcccacgcaaaaagacaaacaguagugguucuaggaucccaagaaggugcaguccacacugcacuggcgggugcacucgaagccgagauggacggcgcaaaaggccggcuaucgagcggccaccuaaaaugcaggcucaagauggacaagcuaagacucaaaggcgugagcuacucacucugcaccgcagcguucacauucaccaaaaucccagccgaaacccuacacgggacagucacaguggagguccaguaugcaggcaccgauggcccaugcaaaguaccggcccaaauggcaguagacaugcagacacuaacaccggucggccgacuaauaacagcaaacccaguaaucacagaaagcaccgagaacucgaaaaugaugcuagaacucgaucccccauucggcgacagcuacaucguaaucgggguaggggagaagaaaaucacccaccauuggcaccggagcggcagcacgaucgggaaagcauucgaagccacgguacgaggagcgagacgaauggcaguccucggggacaccgcaugggacuucggcaguguuggcggagcauugaacucgcucgggaaagggauacaccagauuuucggggcagcauucaaaucacuauucggagggaugagcugguucagccagauccucaucggaacccuacugauguggcuuggacuaaacaccaaaaacggauccauaagccuaaugugccuagcccugggaggaguccuaauauuccuaaguacagccguaagugccgacguaggaugcagcgucgacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5074 - RNA, 2359 nt, Artificial Sequence
  KY317938.1 prME-long mRNA Design 1 opt
gggagaaagcuuaccaugcgaaucauaaacgcccgaaaagaaaagaaacgacgcggagcagaaaccucgguaggcauaguaggacugcuacuaaccacagcgauggcagccgaaguaacaagaagagguucagccuacuacauguaccucgaccgcaacgacgcaggcgaagcgaucagcuucccaacgacgcuaggaaugaacaaaugcuacauacaaauaauggaccugggccauaugugcgacgccacgaugaguuacgaaugccccauguuggacgagggagucgagccagacgacgucgacugcugguguaacacaacgagcacgugggucgucuacggaaccugccaccacaagaaaggcgaagcccgacgaucaagacgcgcaguaacacuaccgagccacuccacacgcaaacuccaaacaagaagccaaaccuggcucgaaagccgagaauacacaaaacaccuaauccgcguagaaaacuggaucuuccgcaacccaggcuucgcacuagcagccgccgcaauagcauggcuccucgguagcagcaccagccaaaaagucaucuaucuaguaaugauacuccuuauagcgccagcauacuccauucgaugcaucggcguuaguaaccgcgacuucguagaaggaaugucggguggaaccuggguagacgugguacucgagcacgguggcugcguaacggugauggcgcaagacaaacccacagucgacaucgaacucgugacaacaacaguaagcaacauggccgaaguccggucauacugcuacgaggcaucaaucagcgauauggccucagacagccgcugccccacgcagggcgaagccuaccucgacaaacaguccgacacacaauacgucugcaaacgaacgcuagucgacaggggaugggggaacggcugcggacucuucggcaaaggaucccuaguaaccugcgcaaaauucgccugcucaaagaaaaugacaggaaaaagcauucaaccagaaaaucuagaauacagaaucaugcugucaguucacggcucacaacacagcggcaugauaguaaacgacacaggccacgaaacagacgagaaccgagccaaaguagaaaucacucccaauagcccaagagcagaagcaacccuuggaggguucgggucacuuggacuagacugcgaaccacgaaccggccuagacuucagcgaccuuuacuaccucaccaugaacaauaaacacuggcucguacauaaagaaugguuccacgacaucccacugccguggcacgcaggcgccgacacagguacaccacacuggaacaacaaagaagcacugguagaguucaaagacgcccaugcgaaacgccagaccgucguugugcugggcucacaagaaggagccguacacacagcacuggccggagccuuagaagccgaaauggacggcgcgaaaggacgcuuguccuccggccaccucaaaugccggcuaaaaauggacaaacuacgccugaaaggaguuucguauucacugugcacagcagcguucaccuucaccaaaauaccagccgaaacccuacacggcacaguaaccgucgaaguacaauacgcgggaaccgacgggcccugcaaaguuccagcacaaauggcgguagacaugcaaaccuuaacaccgguaggcagacuaaucacagccaacccagucaucaccgaaaguacggaaaauucgaaaaugaugcuagaacuagacccgccauucggagacagcuacauaguaaucggggucggcgaaaagaaaauaacacaccacuggcacagaagcggcagcacgauaggcaaagccuucgaagccaccgucagaggcgcgaaacggauggcaguacuaggcgacaccgccugggacuucggcagcgucggcggagcccucaacagcuuaggcaagggaauccaccaaaucuucggcgccgcauucaagagccucuucggcggcaugucgugguucucccaaauccucauaggcacucuacuaauguggcuaggacucaacacgaaaaacggcagcauaagccugaugugccucgcguuaggcggaguccucauauuccugagcacagccgucucagcggacgucgggugcagcguggacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5075 - RNA, 2359 nt, Artificial Sequence
  KY075939.1 prME-long mRNA Design 1 opt
gggagaaagcuuaccaugagaauaaucaacgcccgcaaagagaaaaagcgcagaggcgcagacacauccguaggcauaguaggccuacuccugacaacagcaauggccgccgaaguaacccgucgaggaucagccuacuacauguaucuagaccgaaacgacgccggagaagcuaucagcuuccccaccacacucggcaugaauaaguguuacauccaaaucauggaccucggccacaugugcgacgcaaccaugagcuacgaaugcccaaugcuggacgaaggcguagaacccgacgacgucgacugcuggugcaacaccaccuccaccugggucgucuacggaaccugccaccauaagaaaggggaagccagacggagccgacgugcgguaacgcuccccagccacucaacucgcaaacuccaaacccgcagccaaacguggcucgaaagccgggaauacaccaaacaccuaaucagaguggaaaacuggauauuccgaaaccccggauucgcgcucgcagcagccgcgauagcuuggcugcucggaagcuccaccucccagaaaguaauauaucuagucaugauccuccucauagcacccgccuacagccuccgcugcauaggcguauccaaccgagacuucguggaaggcaugagcggcggcaccuggguagaugucguacucgaacacggaggcugcgucaccguaauggcccaagacaaacccacaguagacauagaacuugucacaaccaccguauccaacauggccgaagugcgguccuacugcuacgaagccagcauaucagacauggccucggacucacgaugcccaacccaaggcgaagccuaccucgacaaacaaagcgacacccaauacguaugcaaacgcacacucguagacagaggauggggcaacgggugcggucuuuucggaaaaggaucacucgucacaugcgcaaaauucgccugcuccaaaaagaugaccggaaaaucaauccaaccagaaaaccuagaauaccgcaucaugcucagcguacauggcucccaacacuccggcaugauagucaacgacaccggacacgaaaccgacgaaaaccgcgcaaaaguagaaaucacacccaacagcccacgagccgaagccacccugggaggguucgggagccuaggacucgacugcgaaccgcgaacgggacuagacuucuccgaccucuacuaccuuaccaugaacaacaaacacuggcucguccacaaagaaugguuccacgacaucccauuaccauggcacgccggcgcugauaccggcaccccacacuggaacaacaaagaagcccucgucgaguucaaagacgcucacgcgaaacgccaaaccguagucguacucggcucacaagaaggcgccgugcauaccgcacuagcaggggcacuagaagcagaaauggacggcgcaaaaggccgccucagcucuggccaccuuaaaugcagacuaaaaauggacaagcuacgccuaaagggcgugagcuacucacugugcaccgcagccuuuaccuucaccaaaauccccgccgaaacucuccauggaaccguaacagucgaaguccaguacgccggcacggacggaccaugcaaaguccccgcacaaauggccguugauaugcaaacacugacacccgugggaagacucaucaccgccaacccagucaucaccgaaagcacagaaaacucaaaaaugaugcuggaauuagacccaccauucggcgacucauacaucgugaucggggucggagaaaagaaaauaacacaccacuggcaccgcagcggaucaacaauaggcaaagcauucgaagccacagucagaggggcaaaaagaauggcgguacuaggagacacagcaugggacuucggcucagugggcggagcccucaacucccuuggaaaaggcauucaccaaaucuucggggcagcauucaaaucccuauucggaggaauguccugguucucgcaaauacucaucggcacgcuccuaauguggcuaggacuaaacaccaaaaacggaaguauaucccuaaugugccucgcgcucggaggcguacuaauuuuccugagcaccgcagucagcgcagauguaggcugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5076 - RNA, 2359 nt, Artificial Sequence
  KX806557.2 prME-long mRNA Design 1 opt
gggagaaagcuuaccaugcgcauaaucaaugcacgaaaggagaaaaagcgcaggggagccgacaccaacguaggcauagucggccuacuucuaacaacagcaauggcggccgaaguaacaagacgcggaucagccuacuacauguaccucgaccgaaacgacgccggcgaagccaucagcuuccccaccacccucggcaugaacaaaugcuacauacagauaauggaccucggucacaugugcgacgccacaaugucauacgaaugccccaugcuagacgagggaguggaaccggacgacgucgacugcuggugcaacaccaccagcaccuggguagucuacggaaccugccaucacaagaaaggcgaagccagaagaucccgacgcgcuguaacccuccccagccacagcacucgcaaacuccaaaccaggucacaaaccuggcuagaaucucgagaguacacaaaacacuuaauacgaguagaaaauuggauguuccgaaaccccggauucgcccucgcggcagcagcaauagccuggcuccucggauccuccacaucgcaaaaagucauauaccuuguuaugauccuacuaaucgcaccggcauacagcauccgcugcaucggagucucaaacagagacuucgucgaaggaaugucgggcggcacaugggucgacgucguucuugagcacggaggaugcgucacggucauggcucaagacaaaccuacaguagacauagagcugguuacaacaaccguguccaacauggccgagguccgguccuacugcuacgaggcauccaucagcgacauggccuccgacucacgaugcccaacccaaggggaggcuuaccucgacaaacaaagcgacacacaauacgucugcaaacgaacacugguugauaggggauggggcaacggcugcggccuuuuuggcaaaggaagccuggucacaugcgccaaguucgccugcagcaagaaaaugacgggcaaaaguauacaaccagaaaaccuggaauaccgaaucaugcucagcguccacgguucccaacacuccggcaugauaguaaacgacacaggccacgaaacagacgaaaacagagcaaaagucgaaaucacccccaacagcccacgggccgaagccacacugggcgguuucggcagccucggacucgacugcgaaccgcgcacgggacucgacuucucagaccucuacuacuuaacaaugaacaacaaacacuggcucguccacaaagaaugguuccacgacauuccccuaccauggcaugccggagcggacaccggcacaccccacuggaacaacaaagaagcacuggucgaguucaaagacgcacacgccaaacggcaaacagucgucguccuaggaucacaagaaggagcaguccacacggcacuagcgggcgcccuagaagccgaaauggauggcgcaaaaggccggcuaucaagcggacaccuaaaaugcagacuaaaaauggacaaacuuagacucaaaggcguaagcuacagcuuaugcacagccgccuucaccuucacgaaaauccccgcagaaacacuccaugguacagucacgguagaagugcaauacgccggcacagacgggccaugcaaagucccugcacaaauggcagucgacaugcagacccuaaccccagucggccgacucauaacggccaauccagucaucacagagucaaccgagaacagcaaaaugaugcucgagcucgacccgccauucggcgacagcuauaucgucaucggugucggcgaaaagaaaaucacacaccauuggcacaggagcgguagcacaauaggcaaggcauucgaagcaaccguccgcggcgccaaacgcauggccguccuaggagacaccgccugggacuucggaucaguagggggcgcccucaauagccugggcaaaggcauccaucaaaucuucggggcagccuucaaaagccuuuucgguggaauguccugguucagccaaauccucauaggcacccuccuaauguggcucggccucaacacgaaaaacggguccauaucccucaugugucuagcacuaggcggaguccucaucuuccucuccaccgcggucucggccgacgucggaugcucgguagauuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5077 - RNA, 2359 nt, Artificial Sequence
  KU870645.1 prME-long mRNA Design 1 opt
gggagaaagcuuaccaugagaauaaucaacgcccgaaaagagaaaaagcgccgaggcgccgacacaagcgucggcaucgucggacuucuccuaacaacagccauggccgcggaaguaacaagaaggggcagugcauacuacauguaccucgaccgcaacgacgcaggagaagccaucagcuuccccacaacauuaggcaugaauaaaugcuacauacagaucauggacuugggccacaugugcgacgccacaaugagcuacgaaugccccaugcucgacgaaggcguagaaccagacgacgucgacugcuggugcaacacaacaagcacgugggugguauacggaaccugccaccacaagaaaggagaagcaagacgaagccguagagcagugacacuccccagccacucgaccagaaaacugcaaacacgcagccaaaccuggcucgaaucacgagaauacaccaaacaccucauccgagucgaaaacuggauacuacggaaccccggauuugcacucgcagcagccgccaucgcauggcuacucggcucaucgaccucccagaaagucauauaccuuguaaugauacuccuaaucgcgcccgccuacagcauccgaugcaucggcgugucuaaucgagacuucguagaaggcaugagcggaggcacaugggucgacgucguacuggagcacggaggcugcgugacgguaauggcacaggacaaacccacagucgacauagagcuagucacaacgaccgucuccaacauggcagaaguacgcagcuacuguuacgaagccagcauaagcgacauggccagugacagccggugcccaacccaaggggaagccuaccuagacaaacaaagcgacacacaauacguaugcaaaagaacccucgucgaucgaggcuggggaaacggaugcggccucuucgggaaaggaucccucgugaccugcgccaaauucgcaugcagcaagaaaaugaccggaaaaaguauacaaccagaaaaccuagaguaucgcauaaugcuaucaguccacggcucccaacacuccgggaugauagucaacgacaccggccacgaaacagacgaaaaucgcgcaaaagucgaaaucaccccaaacagcccaagagcugaagccacccuaggaggauucggaucccucggccucgacugcgaaccacgaacaggccucgacuuuuccgacuuauauuaccucacaaugaacaacaaacacuggcuaguccacaaggaaugguuccacgacaucccacuacccuggcacgcaggcgcagacacaggcaccccacauuggaacaacaaagaagcacucguggaguucaaagacgcucacgcaaaacgccaaacaguaguaguccuaggcucacaagaaggugccguccacacagcucucgccggagcccuagaagcagaaauggauggagcaaaaggccgccugucgagcggccaccucaaaugucgacuaaaaauggacaaacuacgccuaaaaggcgucagcuacagcuuaugcacagcagccuucaccuucacaaaaauaccggcggaaacacuccacggcacggucacgguugaaguccaauacgccggcacagacggucccugcaaagucccagcacaaauggcagucgacaugcaaacccuaaccccaguagggcgucuuaucacagccaacccagucauuaccgagucaacagaaaacaguaaaaugaugcuagaacucgacccacccuuuggggacucguacaucgucaucggaauaggagaaaagaaaauaacccaccacuggcaccgaagcggcuccaccauaggcaaagccuucgaagcaacaguaagaggagcaaaacgcauggcaguacuuggagacaccgcgugggacuucggaagcgucggaggcgcgcucaacagccucggcaaaggcauccaccagaucuucggcgccgcguucaaaagccuguucggaggaaugucaugguucucccagauacuaaucggaacccuccuaauguggcuagggcugaacacgaaaaacggaucgauaagccuaaugugucucgcccuaggaggcguacuaauauuccucuccacagcaguaagcgcagacgucggcugcuccguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5078 - RNA, 2359 nt, Artificial Sequence
  KU729217.2 prME-long mRNA Design 1 opt
gggagaaagcuuaccaugaggauaauaaacgcacgaaaagagaaaaagcgaagaggagccgacacauccgucggaaucgucggacugcuauuaacaacagccauggccgcagaagucacccgcagaggcuccgccuacuacauguaccuagaccgaaacgacgcgggugaagcaaucuccuuccccaccacacucgguaugaacaaaugcuacauacagaucauggaccucggccacaugugcgacgcaacgauguccuacgaaugcccaaugcuagacgaaggcguagaacccgacgacgucgacugcuggugcaacacaaccaguacaugggucguauacgggaccugccaccacaagaaaggagaagcccgaagaucccggcgggcaguaacccuaccgucacacuccacacgcaaacuucaaacgcgaagccaaaccuggcuagagaguagggaauauacaaaacaccuaauaagaguagagaacuggauauuccgcaaccccggauucgcgcucgcggccgccgcaauagcauggcuacucggcagcagcaccagccagaaaguaauauaccuagucaugauccuacucauagccccggcuuacucaauccgcugcauaggggucagcaaccgcgacuucguagaaggcaugagcggaggaacauggguggauguaguacuagagcacggcgggugcguaaccguaauggcacaagacaaaccuaccgucgacaucgaacucguaagcacaacuguauccaacauggccgaaguaaggucuuacugcuacgaagccaccauauccgacaucgccuccgacuccagaugcccaacgcaaggggaagccuaccuagacaaacaauccgacacacaauauguaugcaaacgaacccuagucgacagaggauggggaaacggcugcggacuauucggcaaaggaagucugguaaccugcgcaaaauucgcaugcuccaagaaaaugacaggaaaauccauacaacccgaaaaccucgaauaccgcaucaugcuaagcguccacggaagccaacacagcggaaugaucgucaacgacaccggacacgaaaccgacgaaaaccgagccaaaguagaaaucacaccaaacagcccccgcgccgaagccacccucggcggcuucggcucccuaggacuggacugcgaaccacgaaccggccuagacuucagcgaccuauacuaccuaaccaugaacaacaaacacuggcuaguccacaaagagugguuccacgacaucccauugcccuggcacgccggagccgacaccgguacaccccacuggaacaacaaagaagcccuaguagaauuuaaagacgcccacgcuaaaagacaaaccgcagucguccucggaucccaagaaggcgccguacacacagcacuagcaggcgcgcucgaagccgaaauggauggcgcgaaaggaagacucagcagcgggcaccucaaaugccgguuaaaaauggacaaacuccgccucaaaggcgucucauacagccucugcaccgcagcuuucaccuucacuaaaauccccgcggaaacucuacacgggacagugaccgucgaaguccaauacgccggaacagacggcccaugcaagguaccagcacaaauggcagucgacaugcaaacccuaaccccgguaggaagauuaauaacggccaacccuguaauaaccgaaagcaccgaaaacagcaagaugaugcucgaacucgaucccccuuuuggcgacagcuacaucguaaucggcgucggcgaaaagaaaaucacccaccacuggcaccgauccggauccacaaucggcaaagccuucgaagcaacgguccggggagccaaacgaauggcgguccugggagacacggcaugggacuucggauccguagguggggcccuaaacucguuaggcaaaggcauccaccagaucuucggcgcagccuucaaaucacucuucgggggaaugagcugguucucgcaaaucuuaaucggaacacuucuaauguggcucggccuuaacaccaaaaacggaagcaucucgcugaugugccuagcacuaggcggaguccucauauuccuaagcacagccguauccgcagacgugggcugcagcguugacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5079 - RNA, 2359 nt, Artificial Sequence
  KU497555.1 prME-long mRNA Design 1 opt
gggagaaagcuuaccaugagaaucauaaacgcacgcaaggaaaagaaacggcgcggcgccgacacauccguaggcaucgucggcuuacuccuaacaacagcaauggcagccgaaguaacaaggcgaggaagugccuacuacauguaccuggacaggaacgacgcaggagaagccaucagcuucccaaccacucucggcaugaacaaaugcuauauacaaaucauggaccuaggacauaugugcgacgcaaccaugagcuacgaaugccccaugcuagacgaaggaguggaaccagacgauguagacugcuggugcaacacaaccucaacaugggucguauacggaaccugccaccacaagaaaggugaagcccgacgcucaagacgagcgguaacacucccuagccacucuacccgaaaacuccaaacccgcagccaaacauggcucgaaucccgagaguacacaaaacaccuaauacgaguagaaaacuggauauuccgaaacccgggauucgcccuagccgcagccgcaaucgccuggcuccuaggcagcagcaccucgcaaaaagucaucuaccuagucaugauacuacucauagcccccgccuacagcauccgcugcauaggaguaucgaaccgggacuucguagagggcaugagcggcggcaccugggucgacguaguacuagaacacggcgggugcguuacggucauggcacaagacaaacccacggucgacaucgagcuagucacgaccaccgucucaaacauggcagaaguccgcuccuacuguuacgaagcaucaaucagcgacauggcguccgacuccaggugcccgacccaaggagaagccuaucucgacaagcaaagcgacacacaguauguuugcaagcgcacccuugucgacaggggcugggguaacggcugcggccucuucgggaagggcucccuagucacaugugcaaaauucgcaugcagcaagaaaaugaccggcaaauccauccaaccagaaaaccucgaauaccgcauaauguuaagcguacacggcucccaacauuccggcaugaucguuaacgacaccggacacgaaacagacgaaaaccgagcaaaagucgaaauaacaccaaacagcccccgagcagaagccacccuaggaggauucggaucacucggacuagacugcgaaccgcgaaccggacucgacuucucagaccuuuacuaccuaacaaugaacaacaaacacuggcucguacacaaagaaugguuccacgacauaccacugcccuggcacgccggcgcagacacaggaacgccacacuggaacaacaaagaagcccuagucgaguucaaagacgcacacgccaagcgacaaacagugguaguacucggaacccaagaaggggccguccacaccgcccuggcaggagcacucgaagccgaaauggacggggcgaagggacgccucuccucaggacacuuaaaaugcagacuuaagauggacaaacuccgacuaaaaggagucagcuacagccuaugcaccgcagcauucacguucaccaaaauaccagcugaaacacuccacggcacggucacagucgaaguccaauacgccggcacagacggaccaugcaaaguacccgcccagauggccguggacaugcaaacgcucacccccgucggacgccucauaaccgccaaccccgucauaaccgaauccaccgaaaacagcaaaaugaugcuagaacucgacccucccuucggagacucauacaucgucauaggcgucggcgaaaagaaaaucacgcaccauuggcacagauccggaucaacaauaggcaaagcauucgaagcaacagugagaggggccaagcgaauggcaguccuuggagacacagcaugggacuucggaagcguagguggugcgcuaaacucccuaggcaaaggaauccaccaaaucuucggagcagcauucaaaagccuuuuuggcggaaugucgugguucagccaaauccuaaucgggacgcugcuaauguggcuaggacuaaacacgaaaaacggauccaucucgcugaugugccuagcacuaggcggaguccugaucuuccuuucaaccgccgucuccgcagacguaggcugcucagucgacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5080 - RNA, 2359 nt, Artificial Sequence
  KX087101.3 prME-long mRNA Design 1 opt
gggagaaagcuuaccaugcgaauaaucaacgcccgaaaagaaaagaaaagacgaggggcagacacauccgucggcauaguagggcuccuccucacaacagccauggccgcagaaguaacccgacgaggcagcgcauacuauauguaccucgacaggaacgacgccggugaggcaauaucguuccccacgacccucgggaugaacaagugcuauauacagaucauggaccucggccacaugugcgacgcaacaaugucauacgaauguccaaugcucgacgagggaguagaacccgaugacguugacugcugguguaacaccaccagcacguggguugucuacggaaccugccaucacaagaaaggcgaagcccgacgcucccgcagagccgucacacugcccucgcauucaacaagaaaacuccaaacacgcucccaaacauggcucgaaucccgcgaauauacaaaacaccucauccgcguagaaaacuggauauucaggaaucccggguucgcccuagccgccgcagcaaucgccugguugcucggcucaagcaccagccaaaaaguaauauacuuagucaugauccuacucaucgcccccgcguacagcauccgcugcaucggagucaguaaccgggacuucgucgaaggcauguccggaggaacauggguggacgucguacuagagcacggaggcugcgugaccguaauggcacaagacaaacccacaguagauauagagcuaguaacgacaaccguauccaacauggcagaaguucgaagcuacugcuaugaagcaagcaucagcgacauggcaagcgacucccgaugccccacccagggagaagccuaccuagacaagcaauccgacacacaauacguaugcaaacgaacccucgucgaccgcggauggggaaacggcugcggccuauucgggaaaggaucccuaguaacaugcgcaaaauucgcaugcagcaagaaaaugaccgguaagagcauccaacccgaaaaccucgaauaccgaauaaugcucaguguacacggcucccaacacagcggcaugaucguaaacgacacaggacacgaaaccgacgaaaaccgugcgaaaguggaaauaaccccgaacucccccagagccgaagcaacccuaggcggcuucggaucacugggccucgacugcgaaccaagaaccggacuagacuucuccgaccuauacuaccucacaaugaacaacaaacacuggcucguacacaaggaaugguuccacgacauaccccuccccuggcacgccggagcagacacagggacaccgcacuggaacaauaaagaagcccuggucgaguucaaagacgcucacgcaaaacgccaaacugucgucguccuuggcagccaagaaggcgccguccacacagcacucgccggugcccucgaagccgaaauggacggagccaaagggcggcuaagcagcgggcaccugaaaugccggcuuaaaauggacaaacuccgacugaaagguguaucauacagccuaugcaccgcagccuucacauucacaaaaauacccgcagaaacacuccacggaaccgucacagucgaacuccaauacgccggaaccgacggacccugcaaagugccagcccaaauggcaguagacaugcaaacgcucacucccguaggccgccuuauaacugcgaaccccgucauaaccgaaagcacagaaaacagcaaaaugaugcucgaacucgaucccccguuuggggacucauacaucgucauuggcgugggcgaaaagaaaaucacgcaccacuggcaccgcucaggcagcacuaucggaaaagcauucgaagcaaccguccgcggcgccaagagaauggcuguacucggcgacaccgcaugggacuucggaucggucggaggggcccucaacagccucggcaaaggaauacaccaaaucuucggcgccgccuucaaaucucuauucggagggaugucgugguuuucccagauccugauaggcacccuccucauguggcuaggccucaacacgaaaaacggcuccauuagccuuaugugccucgcccuaggcggcguauuaaucuuccucucaacagcagucagcgccgacguagggugcagcgucgacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5081 - RNA, 2359 nt, Artificial Sequence
  KY075932.1 prME-long mRNA Design 1 opt
gggagaaagcuuaccaugcggaucaucaacgcccgcaaagaaaagaagcgcagaggagcagaaaccuccgucggcauagucggccugcuacuaaccaccgccauggccgccgaagucaccagacgaggcuccgccuacuacauguaccucgacagaaacgacgccggcgaagccaucuccuucccuacaacccucggcaugaacaaaugcuacauacaaauaauggaccuaggccacaugugcgacgccacuaugagcuacgaaugccccaugcucgacgaaggagucgaacccgacgacguggauugcuggugcaacaccacaucgacaugggucguguacgggacgugccaccacaaaaagggagaagccagacgaucacgcagagccgucacacuccccagccacagcacgagaaaacuacaaacacguagccaaacguggcucgaaagccgcgaauacaccaagcaccucauccgcaucgagaacuggauauuccgcaaccccggcuucgcacuagccgcggccgccaucgcauggcuacucggaucgagcaccucacaaaaagucauauaccuagucaugauccuacuaauagcccccgcauacuccauacgcugcauuggcgucagcaaccgggacuucguagaaggcaugagcgguggcacaugggucgacgucguccucgaacacggaggcugcguaaccgucauggcucaagacaaaccuacgguagacauagaacugguuaccacaacagucagcaacauggccgaaguccgcagcuauugcuacgaagcaagcauaucagacauggccagcgacucccguugcccaacacagggagaggcauaccuagacaaacaauccgauacacaguacguaugcaaacguacccucgucgaccgcgguuggggcaauggcugcggccuauucggaaaaggaagccucgucacaugugcaaaauucgccugcaguaagaagaugacaggcaaaucaauccaacccgaaaaccuagaauacagaauaaugcucucgguccacggaagccaacacuccggaaugaucguaaacgacaccggacacgaaaccgacgagaaccgcgccaaggucgaaaucacccccaacucaccacgcgcggaagcaacacugggaggcuucggaucacucggacucgacugcgaaccccgaaccggauuagacuuuuccgaccucuacuaccucacaaugaacaauaaacacuggcucguccacaaggaaugguuccaugacauaccacuacccuggcaugccggcgcggauacgggaacgccccacuggaacaauaaggaggcccucguggaguucaaagacgcccacgcaaaacgccaaaccguaguagugcucggcagccaagaaggagcuguccacaccgcccuggccggagcccucgaagccgaaauggacggggcgaaaggacgccucuccucgggccaccugaaaugccgccuaaaaauggacaaacuccgauuaaaaggggucaguuacagccuaugcaccgcggcauucaccuucacaaaaauaccagcagaaacacuacauggaaccgucacagucgaaguccaguacgccggcacagacgguccauguaaaguccccgcacaaauggccgucgacaugcaaacacugacuccagucggaagacucaucaccgcaaacccaguaauaaccgaaucaaccgaaaacuccaaaaugaugcucgaacucgacccaccauucggcgacuccuacauaguaauaggcgucggagaaaagaaaauaacacaccacuggcaccgaagcggauccaccauuggcaaggcuuuugaagcaaccguacgaggagccaaacgcauggccgugcuaggagacaccgccugggacuucggcuccgucggcggcgcccuaaacucccugggcaaaggcauacaucaaauauucggcgccgcauucaaaucacucuucggaggcaugagcugguucagccagauccucauaggcacccuccuuaugugguugggccucaacaccaagaacggaagcaucucccucaugugccuagcacucggcggcguacucauauuccucucaacagccgucagcgccgacguaggcugcagcgucgacuucucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5082 - RNA, 2359 nt, Artificial Sequence
  KY014317.1 prME-long mRNA Design 1 opt
gggagaaagcuuaccaugagaauaauaaacgcacgaaaggaaaagaaacgccgaggcgcggacacaagcgugggaauagucggacuccuacucacaacggcaauggcagccgaagucacacgaaggggcucagcuuacuacauguaccuggacagaaacgacgccggggaagcaaucagcuuuccgaccacacuaggaaugaauaaaugcuacauacaaauaauggaccucggacacaugugcgaugcaaccaugucguacgaaugcccaaugcuugacgagggcguagagcccgacgacgucgauugcugguguaacaccacgagcacauggguaguuuauggaacaugccaccacaagaaaggagaagcacgcagaagcagacgcgcugucacgcucccaagucacagcacgcgcaagcuccagacccggagccagaccugguuagaaagccgcgaauacaccaaacaccucaucagagucgaaaacuggaucuucagaaacccaggguucgcacuagcagccgccgccauagccuggcuacucggauccuccacgagccagaaaguaauauaccucguaaugauacuccugaucgcaccagcauacucgauccgcugcauaggcguaagcaaccgggacuucguggaagggaugucaggaggaaccugggucgauguaguucuugagcacggaggaugugugacgguaauggcucaggacaaacccacgguagacauugaacucgucaccaccaccgugagcaacauggcagaagugcgaucauacugcuacgaggccuccauauccgacauggccagugacucaagaugcccaacgcaaggagaagcguaccuagacaaacaaucagacacgcaguacgucugcaaacgaacgcuagucgaccgcggaugggggaacgggugcggacuauuuggcaaaggcucacuggugacaugcgccaaauuugcaugcucaaagaaaaugacaggcaaauccauacaacccgagaaccucgaauaucggaucaugcuauccguacauggcucacaacauagcggcaugauagucaacgacacaggacacgaaacagacgagaacagagccaaagucgaaauaaccccaaauagcccccgcgcggaagcaacccucggaggauucggaagccuaggacuggacugugaaccaagaacaggcuuggacuuuagcgaccucuacuaccugacaaugaacaacaaacacuggcuaguccacaaagaaugguuccacgacauaccgcuaccguggcacgcaggggccgacaccggcaccccgcauuggaacaacaaagaggccuuagucgaguucaaagacgcacacgcaaaaagacaaacgguaguaguacucggcucgcaagaaggcgccguacacaccgcgcucgcaggagcccucgaagcggaaauggacggagcaaaaggucgccugagcuccggccaucucaaaugcagacuaaaaauggacaaacugagacucaaagggguaucuuacagccuaugcacggcagccuucacauucacaaaaaucccugccgagacacuacacgggacggucacagucgagguacaauacgccggaaccgacggaccaugcaagguacccgcccaaauggccgucgacaugcaaacacuaacaccagucgggcgccuaaucacagcuaaucccgucaucacugaaucaaucgaaaacagcaaaaugaugcuagaacuagauccgcccuucggcgacagcuacaucguaaucggcgucggagaaaagaaaaucacacaccacuggcauagaagcgggagcacaauaggcaaagcauucgaagccacaguacgcggagcgaaacgaauggcaguccucggcgacaccgcgugggauuucgggagcgucggcggcgcacucaacucgcucggaaaaggaauccaccaaaucuucggagccgcauucaaaagccuauuuggcggcaugagcugguuuagccaaauacucaucggaacacuccugauguggcucggacucaacacgaaaaacggcagcauaaguuugaugugccucgcccucggagggguacucauauuucugagcacagccgucagcgcagacguagggugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5083 - RNA, 2359 nt, Artificial Sequence
  KU758876.1 prME-long mRNA Design 1 opt
gggagaaagcuuaccaugcgcaucauaaacgcccgcaaagaaaagaaacgcagaggcgcagacacaucagucggcaucguaggacuucuacuaacuaccgcgauggcagcagagguaacccgccgcggauccgcauauuacauguaccucgaccgcaacgacgcgggcgaagcaaucucauucccaacaacccugggaaugaacaaauguuacauccaaaucauggaccucggacacaugugcgacgcaaccauguccuacgaaugccccaugcuagacgaaggcgucgaaccagacgacgucgacugcuggugcaacaccaccagcacauggguuguauacggcacgugucaucacaagaaaggagaagcgcgccgaagccgacgcgcagugacgcugcccucccacuccacccgcaaacugcaaacgcgcucccagacauggcuagagagccgagaguacaccaaacaccuaauccgaguagaaaacuggaucuuccgcaacccaggcuucgcacucgccgccgccgcaaucgccuggcuacucggaucuagcaccagccaaaaaguaaucuaccucgucaugauccuccugaucgcucccgccuacagcauccggugcaucggggucagcaacagagacuucguagaaggaauguccgggggaacauggguagacgucguccuagaacacgggggcugcguaacugucauggcucaggacaaacccacagucgacauagaacuugucaccaccaccgucagcaauauggcggaaguacgcagcuacuguuacgaagcaagcauaucagacauggccucugacagccguugcccgacccaaggagaagcauaucucgacaaacaguccgacacccaauacgucugcaaacgaacccucguagaccgaggaugggggaacggauguggacucuucggcaaaggaagccucguaaccugcgcaaaauucgcauguuccaagaaaaugaccggcaaaucaauccaaccagaaaaccucgaauaccgaaucaugcucagcguccacggaucccagcacuccggcaugaucguaaacgauacuggccacgaaaccgacgaaaaccgagccaaagucgaaauaacccccaauagcccacgcgccgaagccacccuaggcggauucggcucccucggccucgacugcgaaccacgcaccggccuagacuucagcgaccucuauuaccuaaccaugaacaacaaacacuggcugguccacaaagaaugguuccacgacaucccccucccuuggcacgccggggcggacacaggaaccccacacuggaacaauaaagaagcacucgucgaguucaaagacgcacacgcuaaaaggcaaaccgucguaguacuaggcagccaagaaggagcaguucacaccgcauuagccggcgcacuagaagccgaaauggacggagucaaaggacgccucuccuccggacaccuaaaaugccgccucaaaauggacaaacuacgccuaaaaggaguaaguuauucacucugcacagcagccuucacauucaccaaaaucccagcagaaacccuacacggcacagugacaguggaaguccaauacgcaggcaccgacggcccaugcaaagucccugcacagauggccgucgacaugcaaacccucacaccagucggcaggcucaucaccgcuaacccaguaaucaccgaaucaaccgaaaacucaaagaugaugcucgaacucgacccgcccuuuggggacuccuacaucgugaucgggguuggggaaaagaaaaucacccaccacuggcaccguucaggaucaacaaucggcaaagcauucgaagcaaccguacgaggcgcaaaaagaauggccguacuaggcgacacagcaugggacuucggcucagucggcggggcccuaaacucccucggcaaaggcauacaccaaaucuucggagcagcauucaagucccucuucggcggcaugagcugguucagccaaauccucaucggcacacugcuaauguggcugggacucaacaccaaaaacggaucgaucucauucaugugccuggcacucgguggcgugcucauauuccucagcacagccgucuccgcagacgucggcugcagcguagauuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5084 - RNA, 2359 nt, Artificial Sequence
  KU758874.1 prME-long mRNA Design 1 opt
gggagaaagcuuaccaugaggauaauaaacgcccgaaaggaaaagaaacgacgaggagccgacacauccgucggcaucguaggacuccuccuuaccaccgccauggcggcggaggucacacgcagagggucagccuacuacauguaccuagaccgcaacgacgccggcgaagcgaucaguuuucccaccacgcugggaaugaacaaaugcuacauccaaaucauggaccuaggacacaugugcgacgccacaaugucauacgaaugccccaugcucgacgaaggcgucgaaccagacgacgucgacugcuggugcaacacgaccuccacaugggucguguacggaaccugucaccacaagaaaggcgaagcccgacgaucacgcagagccgucacccuacccucccacagcacccgcaaacuucaaaccagaucacaaaccuggcucgaaucccgagaguauacaaaacaccucauacgagucgaaaacuggaucuuccgcaacccaggauuugcccuggcggccgcugccauagccuggcuacucggcuccucaaccucacaaaaggucauauaccucgucaugauccuccuaaucgcccccgccuacagcauccgcuguauaggagucucaaacagagacuuuguagaaggaaugucaggcgggaccuggguugacgugguacuggaacacggcggcugcguaacugucauggcgcaagacaaacccacaguggacauagagcuaguaaccaccaccguaagcaacauggcagaaguacgcuccuacugcuacgaagcaucgaucuccgacauggccucagacucccgcugccccacccaaggcgaagcauaccucgacaaacaaucagacacccaauacgucugcaagcgcacccucguagaccgcggauggggcaacggcugcggccuguucgggaaaggcucccuaguaaccugcgccaaauucgcaugcagcaaaaagaugacuggcaaauccauccaacccgagaaccucgaauacagaaucaugcucucaguccacggaucccaacacuccggcaugauagucaaugacacgggacacgaaacagacgaaaaccgcgcgaaagucgagaucaccccaaacucaccccgagcagaagcaacccuuggaggauucggcagccuaggacucgacugcgaacccagaaccggccuagacuucuccgaccucuacuaucucaccaugaacaacaaacacugguuaguccauaaggaaugguuccacgacaucccccuccccuggcacgcaggcgcugacaccggcacaccccacuggaacaacaaagaggcacucgucgaguucaaggacgcccacgcaaaacgacaaacaguagucguacucggcucccaggaaggcgcaguacacacagcccuagcaggcgcacucgaagcggaaauggacggagcaaaagguaaacuuucaagcggccaccucaaaugccgacugaaaauggacaagcugcgccuaaaaggagucagcuacagucucugcacggccgcauucacauuuacaaaaauaccagccgaaacgcuacacggcaccgucaccgucgaaguccaauacgccggcaccgacggccccugcaaaguacccgcacaaauggccguagacaugcaaacccucacaccgguaggacgccucaucaccgcaaaccccgucauuacagaauccaccgaaaacucaaaaaugaugcucgaacuagaucccccguuuggugacuccuacaucgucaucggaguaggagaaaagaaaauaacacaccacuggcaccgcagcggaucgacaaucggaaaagccuucgaggcaaccgugcgcggcgcaaaacgaauggccguccucggagacaccgccugggacuucggcuccgucggcggggcacuaaacagccuaggaaaaggaauccaucagauauucggagcagccuucaaaucacuguucggaggcauguccugguucucccaaauacugauaggcacacuacucaugugguuaggccucaacaccaaaaacggaagcauaagccucaugugccucgcccucggcggcguccucauauuccucuccacagcggucuccgcagacgugggaugcagcguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5085 - RNA, 2359 nt, Artificial Sequence
  KY014314.1 prME-long mRNA Design 1 opt
gggagaaagcuuaccaugcgaaucaucaacgcacgcaaagaaaaaaaacggcgaggcgccgacaccagcguaggcauaguaggacuccuacuaacaacagccauggccgccgaaguaacccgacgcggcuccgccuacuacauguaucucgaccggaacgacgccggcgaagcaauauccuuccccacaacccucggcaugaacaaaugcuacauacaaaucauggaccucggccauaugugcgacgcaacaaugucauacgaaugccccaugcucgacgaaggcguugagccagacgacgucgacuguuggugcaacaccacaagcaccuggguagucuacggaacaugccaccauaaaaaaggcgaagccagacgauccaggagagcgguaacucugccaucacacuccacacgaaaacuacaaaccagaucccaaacauggcucgaaagccgcgaauacaccaagcaccucauccgcguagagaacuggauuuuccgaaaccccggauucgcccuagccgccgccgccaucgccuggcuucugggauccucgaccagccaaaaaguaaucuaccucgucaugauccucuuaauagcccccgcguacagcauacgaugcaucggaguaucgaaccgcgacuucguagagggaaugagcggcggcacauggguagacguaguacucgagcacggagguugcguaacagucauggcacaagacaaaccuacaguggacaucgaacucguaacgaccaccgucagcaacauggcggaagugcgcucauacugcuacgaagcaucgauaagcgacauggccuccgacucccgcugcccaacgcaaggcgaagccuaccucgauaaacaguccgacacccaguacgucugcaaacgcaccuuagucgacaggggauggggaaacggcugcggccuauucggcaaaggcagccuugucaccugcgccaaauucgcgugcagcaaaaaaaugacaggaaaauccauccaacccgaaaacuuagaguaccgcauaauguuaucaguccacggaucccaacacucaggaaugaucgucaacgauacaggccacgaaacagacgaaaaccgcgccaaagucgaaaucacacccaacuccccccgcgcagaagccacccuaggcggguucggaagccucggacuagacugcgagccccgcacaggacuugacuucagugaccuauacuaccuaacaaugaacaacaagcacuggcucguccacaaagaaugguuccacgacaucccccuacccuggcacgcaggagccgauaccggcacaccucacuggaauaacaaagaagcgcuagucgaauucaaagaagcacacgcaaaacgacaaacaguaguaguguuaggcucacaagaaggcgcaguccacaccgcgcuagccggagcccuagaagcggaaauggacggcgcaaaaggccgccuaucaagcggccaucuaaagugucgacuaaaaauggacaaacuccgacugaaaggcguauccuauagccugugcaccgccgcauucaccuucacaaaaauccccgcagagacccuucacggaacggucacuguagaaguccaguacgcaggcaccgacggaccaugcaaaguccccgcacaaauggccguugacaugcaaacccuaacaccagucggaagacucauaaccgccaacccagucaucacagaaaguaccgaaaacagcaaaaugaugcucgaacucgaccccccguucggcgacagcuacaucgugaucggcguaggcgaaaaaaaaauaacgcaccacuggcauagaucaggcagcaccauaggaaaagccuucgaagcaacaguacgcggcgcaaaacgaauggccguacucggcgacacggcaugggacuucggcuccgugggcggagcgcugaauagucugggcaaagguauccaccaaaucuuuggggccgcauuuaaaucccucuucggcggcaugucaugguucucacaaauccuaauaggaacacuucugauguggcugggacucaacacgaaaaacggcuccaucucccugaugugccuagcacucggcggcguacugauauuccuauccacagcagucucagcagacguaggcugcucggucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5086 - RNA, 2359 nt, Artificial Sequence
  KU926310.1 prME-long mRNA Design 1 opt
gggagaaagcuuaccaugcgaaucaucaacgcaaggaaagaaaagaaaagacggggcgcggacacaagcgucgggaucgucggucuacuacucacaaccgcaauggccgcugaagucacccgcagaggcagcgcauauuacauguaccuggacagaaaugacgcaggagaggcaaucagcuuccccacaacgcuaggcaugaacaaaugcuacauacaaaucauggaccuaggacacaugugcgaugcgacaaugagcuaugagugccccaugcucgacgaaggagucgaaccagacgaugucgacugcuggugcaacaccacaagcacgugggucguauacggcacaugccaccacaaaaagggcgaagcacgacgaagcagacgagccgucacacugccaucacacuccacacgcaaacuccaaacacggagccaaacauggcuggaaucccgggaauacaccaaacaccucauccgggucgaaaacuggauauucagaaacccaggauucgcccucgcagcugccgccauagcauggcuccuaggcucaagcacaucacaaaaagugauauaccuuguaaugauacuacucaucgcgcccgccuacucaauacgaugcauagggguaagcaaucgcgauuucguggaagguaugucagguggcaccuggguagacgucgugcucgagcacggaggauguguaacgguaauggcacaggacaaacccacggucgacaucgagcucgucaccacgacgguaagcaacauggccgaaguacgcucauacugcuacgaggcguccauaucagacauggcaucagacagccgcugccccacccagggagaggcauaccuggacaaacaaagugauacacaauacguaugcaaacggacgcucgucgacagaggcuggggcaacggauguggacuauucggcaaaggaagccuaguaacgugcgccaaauucgccugcagcaagaaaaugacaggaaaauccauacaaccagaaaaccuagaauaccgaauaaugcucucaguacacggcucacaacacaguggcaugauaguaaacgacaccggccaugaaacugacgaaaaccgcgccaaagucgaaaucacccccaacagcccgcgagcagaagcaacacucggaggauucggauccuuaggacucgacugcgaaccacgcacaggacucgauuucagcgaccucuacuaccucacgaugaacaauaaacauuggcuaguccacaaagaaugguuccacgacaucccccuacccuggcacgcaggcgccgacacaggaacaccccacuggaacaacaaagaagcacugguagaguucaaagacgcacacgccaaacgccagacagucgugguccuaggaucacaggagggggcaguccacaccgcacucgccggagcccuagaagccgagauggacggagccaaaggaagacucagcucgggccaccucaaaugcagacuaaaaauggauaaacuaagacucaaaggugucuccuacucccucuguacagccgccuucacauucaccaaaauaccagccgagacgcuacacggcaccguaacagucgaggugcaguacgcaggcgcggacggaccaugcaaggugccagcccaaauggccguagacaugcagacccucacaccgguaggccgacuaauaaccgccaaucccguaauaaccgaauccaccgaaaacucaaaaaugauguuagaacuggacccgcccuucggggacagcuacauagucaucggagugggagaaaagaaaaucacacaccacuggcacagaaguggaagcacaauagggaaagcguuugaggccaccguacgcggcgccaaacgcauggcaguccuaggagacaccgcaugggacuucggcagcgucggcggagcacucaacucacugggcaagggaauccaccaaauuuucggcgcagcauucaaaagccuauucggaggaaugagcugguucucacaaauacugaucggcacacuacuaauguggcugggacugaauaccaaaaacggaagcaucaguuuaaugugccuugcacuaggaggcguacugauauuccuaagcacagccgucuccgcagacguggggugcagcguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5087 - RNA, 2359 nt, Artificial Sequence
  KU761560.1 prME-long mRNA Design 1 opt
gggagaaagcuuaccaugagaauaauaaacgcagggaaagagaagaaacgaaggggagccgacacaaacgucggcaucgucggacuauugcuaacaacggcgauggcagccgaaguaacacgccgcggaucagcguacuacauguaccuggaccgaaacgacgccggagaagcaaucuccuucccaaccacgcucggcaugaacaaaugcuacauccaaauaauggaccuaggacacaugugcgacgccaccauguccuacgaaugcccgaugcucgacgaaggcgucgaaccagacgaugucgauugcugguguaauaccacgaguacaugggucgucuacggcacaugccaucacaagaaaggagaagcacgcagaagcagacgcgccguaacacuaccaagccauuccacaagaaaacuacagacaaggagccaaacauggcuggaaagccgcgaauacacaaaacaccuaaucagaguggaaaacuggaucuucaggaauccaggauucgcacuggccgcggcggcaauagcguggcuccuaggaagcaguacaucacaaaaaguaaucuaccucguaaugauauugcugaucgcgccagccuacucuauaaggugcauaggagucagcaaccgugacuucguagaaggaauguccggcggcaccugggucgacgucgugcucgaacacggagggugugucaccguaauggcccaagacaaacccaccguagacauagaacuggucacaacgaccguaagcaacauggcagaagugcgcagcuacugcuacgaggccucaaucagcgacauggcaagcgacucccgcugcccaacacaaggcgaagcauaccuggacaaacagagcgacacccaguaugucugcaaaaggacccucgucgaccgaggauggggaaacggaugcggccuauucggcaaaggaucccuagugacgugcgccaaauucgcaugcaguaagaaaaugaccggcaaaagcauacaaccagaaaacuuagaauacaggaucaugcucucagugcacggaucacaacacagcggaaugauagucaacgacaccggccacgaaacggacgaaaacagagccaaagucgaaauuacacccaacaguccacgcgcagaagcgacccucggaggguucgggagcuuaggacucgacugcgaaccacgaacgggacucgacuucagcgaccuguauuaccuaacaaugaacaacaaacauuggcuagugcacaaagagugguuccacgacaucccccuaccauggcacgccggggccgacacaggcacaccccauuggaacaacaaagaagcucuagucgaguucaaagacgcacacgcaaaaaggcaaaccgucgugguacuuggcagccaagaaggcgcaguccacacugcacuagcaggagcgcuagaagccgaaauggacggagcaaaaggccgccuauccucggggcaccucaaaugcagauugaaaauggacaaacuaagacugaaaggaguaucauacucccucugcaccgcugccuucaccuucaccaaaauacccgcagaaacccuccacggaacgguaacagucgaaguacaguaugccggaaccgacggccccugcaaggucccagcccaaauggccgucgacaugcaaacacuaaccccaguuggccgccuaaucacggccaacccaguaaucacagaaucaaccgagaacuccaaaaugaugcucgaacucgacccacccuucggagacagcuacaucguaaucggcgucggcgaaaagaaaauaacccaccacuggcaccgcagcggaagcacaauuggcaaagcguucgaagcaacggucagaggcgcacgcagaauggcaguucucggcgauacagcaugggauuucggcagcguaggaggggcgcucaacucccucgggaaaggcauacaucaaaucuuuggggcagcguucaaaagccuguucggcggcaugucaugguucagucaaauccuaauaggaacacuccuaauguggcucgggcuaaacacgaaaaacggguccaucagcuuaaugugccucgcacucggaggaguacucaucuuccuauccacagcuguaagcgcagacgucggaugcucaguggacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5088 - RNA, 2359 nt, Artificial Sequence
  KY317939.1 prME-long mRNA Design 1 opt
gggagaaagcuuaccaugcgcauaaucaacgccagaaaagagaagaaacgacgaggagcagaaaccagcguggggauagugggccugcuccuaaccacagcaauggcugccgaagugacacgaagaggaagcgccuauuacauguaccuggacagaaaagacgcaggagaagccaucagcuuuccaaccacacucgggaugaacaaaugcuacauccagauaauggaccuaggccacaugugcgacgcaaccaugucauacgaaugccccauguuagacgaaggcguggagccggacgacguagacugcuggugcaacaccaccagcacuugggugguguacggaacaugccaccacaagaaaggcgaagccagacgcagcagacgagccgucacgcuccccagccacuccacacggaaacuacagacacgaagccaaacauggcuagaaagccgcgaauacaccaaacaccuaaucagagucgagaacuggaucuuccgcaaucccggcuucgcauuagccgcagccgcaauagccuggcuacuaggcagcagcacaucccaaaaaguuaucuaucuugugaugauacugcuaauagcccccgcguacucaauccggugcaucggcgucucaaaccgggacuucguagaaggcaugucaggcggcaccugggucgacgucguacuagaacauggaggaugcgucaccguaauggcccaagacaaacccaccguagacaucgaacucgucacgacuaccgucaguaacauggcagaagugcgauccuacugcuacgaagccagcaucuccgacauggccuccgacagccgcugcccaacacaaggcgaagcauaccucgacaaacaaagcgacacacaauacgugugcaaacgaacccuagucgaccgcggaugggguaacggaugcggccucuucggaaagggcagccuagugaccugcgcaaaguucgcaugcagcaagaaaaugacaggcaaaaguauccagccagaaaaucuggaguacagaauaaugcuuucaguacacggaucacaacacucaggaaugaucgucaacgacacaggccaugaaacagacgagaaccgcgcgaaaguagaaauaacccccaacagccccagagcagaagcaacacucggaggguucggcagccuaggacucgacugcgaaccacgaaccgggcuagacuucagcgaccuauacuacuuaacaaugaacaauaaacacuggcucguucacaaagaaugguuccacgacaucccccuaccauggcaugcaggagccgacaccggaacgccccacuggaacaacaaggaggccuuaguagaguucaaggacgcacacgcgaagcgacaaaccguagucguccuaggaucccaagaaggagccguacacacagcacuggccggcgcccucgaagcagaaauggacggggcaaaaggccgacuaagcagcggccaccuaaagugcagacugaagauggacaaacugagacucaaaggcgucuccuacagccucugcaccgccgcauucacauucaccaagauaccagcggaaacacuacacggaaccgucaccguagaagugcaauacgcaggcacugacggccccugcaaagucccagcacaaauggcaguagacaugcaaacacucacaccaguaggacgacucaucaccgccaacccaguuaucaccgagucaacagaaaacucaaaaaugaugcucgaacucgacccgcccuucggcgacagcuacaucguaauaggagugggagaaaagaaaauaacgcaccacuggcaccggagcggcagcacaauaggaaaagcauucgaagcaacagucagaggcgccaaaagaauggccguccucggcgacacggcaugggacuucgggagcgucggaggcgcauuaaacucccuggggaaaggaauccaccaaauuuucggagccgccuucaaaagccuauucggcgggaugucaugguucagccaaauccucauugggacccuacuaauguggcuaggccugaacacgaagaacggaagcauaucacuaaugugccuagcacuagggggaguccuaauauuccuauccacggcgguaagcgcagacguaggaugcuccguagacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5089 - RNA, 2359 nt, Artificial Sequence
  KY075937.1 prME-long mRNA Design 1 opt
gggagaaagcuuaccaugcgaaucaucaacgcgagaaaagaaaagaaaagacguggagcggacacguccgucggaaucgucggacuauugcuaacgacggcuauggccgcggaagucacacgcagaggcagcgccuacuacauguaccucgaccgcaacgacgcuggcgaagcgaucagcuuccccaccacccuuggaaugaacaaguguuacauccagauaauggacuuaggacacaugugcgacgccaccauguccuacgaaugcccuaugcuugacgaaggcgucgagccagacgacguggauugcuggugcaacacaaccagcacauggguaguauacggaaccugccaucacaagaaaggcgaagcccgaaggaguagacgagccguaaccuuaccaucgcacucaacacgaaaacuacaaacccgcucccaaacauggcuagaaucccgcgaauacacaaaacaccucauccgcgucgaaaacuggauauuccgcaaccccggauucgcacuagccgccgccgcaaucgccuggcuacucggaagcucaaccucgcaaaaagucauauaccucguaaugauacugcuaauagcaccggcauacuccauacgauguaucggcguguccaacagggacuucgucgaaggaauguccggaggaaccugggucgacgugguacuagagcacggaggcugcgucacagugauggcccaggacaaaccaacagucgacauagagcuagucacaacaaccguguccaacauggccgaaguaagguccuacugcuacgaagccagcauaagcgacaugguaucagauucgcgaugccccacccaaggcgaagcauaccucgacaaacaaagcgacacccaguacguaugcaaacgcacgcucgucgacagaggauggggcaacggaugcgguuuauucggcaaaggaagccuaguaaccugcgcaaaauucgccugcaguaagaaaaugaccggaaaauccauacaaccagaaaaccuagaauaccgcaucaugcucuccguccacggaucacaacacagcggaaugauagucaacgacacgggacacgaaaccgacgaaaacagggccaaaguagaaauaaccccaaacaguccccgugcagaagcaacacucggcggguucggcucacucggccucgacugcgaaccaagaaccggccuagacuucuccgaccucuacuaccuaacaaugaacaacaaacacuggcucguacacaaagaaugguuccacgacauaccccuaccauggcacgccggcgccgacaccggcacuccacacuggaacaacaaggaagcccucguagaguucaaagacgcacacgcuaaacgccaaaccgucguaguccucggaagccaggaaggagccguccacaccgcccuggcaggggcccuggaagcugaaauggacggagcaaaaggcagacucucaagcggccaccuaaagugccgacucaaaauggacaaacucagacuaaagggaguaagcuacagccucugcacagccgcauucacauucaccaaaaucccagccgaaacucuacacggcacagucaccguagaaguacaauacgccggaacagacggaccguguaaaguaccagcucaaauggccguggacaugcaaacacugacacccgucggaagacucauaaccgccaacccagucauaaccgaaucgaccgaaaacagcaagaugaugcuagaacuagacccgcccuucggagacagcuacaucguaaucggcguaggggaaaagaaaauaacccaccacuggcacagaucaggcuccacaauaggaaaagccuucgaagccacaguacgaggcgccaaacgaauggcuguauuaggugacacggcaugggacuuuggaucaguaggcggcgcccuaaacucacuaggaaaaggcauccaccaaaucuucggggcagccuucaagucgcucuuugggggcauguccugguucucgcaaauccucaucgggacccuccuaauguggcuaggacucaacaccaagaacgguucgauaucccugaugugccucgcucucggaggaguccucaucuuccucuccacugccgucagcgccgacguuggcugcucggucgauuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5090 - RNA, 2359 nt, Artificial Sequence
  LC191864.1 prME-long mRNA Design 1 opt
gggagaaagcuuaccaugagaaucauaaacgcaagaaaagaaaagaaaagaagaggcgcggauaccaaugucggaaucgugggacuccuacuaacaacggcaauggcagcggaaguaacccgacgaggcagcgcauacuacauguaccucgacagaaacgacgcaggagaagcaaucagcuuccccaccacucuaggcaugaacaaaugcuacauccaaauaauggaccucgggcacaugugcgacgcgacaauguccuacgaaugccccaugcuggacgaaggcguagaacccgacgacgucgacugcuggugcaacaugacgagcacauggguaguauacgggacgugccaccacaagaaaggcgaagcacgacgaagccgccgggcaguaacccucccaagccacagcacgcgcaaacuacagacucgcucacaaaccuggcucgagagccgagaauacacaaagcaccuaauccgcguagaaaacuggaucuuccgaaaccccggcuucgcacuagcagcagcagcgauagcguggcuacugggcucaagcaccagucagaaagucaucuaccugguaaugauacuacuaauagcaccagccuacagcaucaggugcauaggcguaagcaaccgagacuucguagaaggaaugagcggaggcaccuggguggacgucguucucgaacacggagggugcgucacaguaauggcccaagacaaacccacaguggacaucgagcuaguaacaaccacagucagcaacauggcagaaguccgcucauacugcuacgaagccuccaucuccgacauggccagugacucacgcugcccaacacaaggagaagccuaccucgacaaacaaucagacacacaguacgucugcaaacgcacacuggucgaccgcggauggggaaaugggugcggacuauucggaaaaggaucccucguaaccugcgccaaauucgccugcaguaagaaaaugacaggcaaaucaauccagccggaaaaccuagaauaccgcaucaugcucagcguccacggcagccaacacagcgguaugauaguaaacgacacaggacacgaaacagaugaaaaccgcgcaaaagucgagaucacacccaacagcccccgcgccgaagcaacccuagguggguuuggcagccugggacuagacugcgaaccacgaaccggacucgacuucuccgaccuauacuaccuaacuaugaacaauaaacacuggcucguacauaaggaaugguuccacgacaucccacuaccauggcacgcuggagccgacaccggaaccccgcacuggaacaacaaagaagcgcucguagaguucaaagacgcacacgccaaacgacaaacagucguuguacucgguagccaggaaggagcaguacacacagcacucgccggagcacuagaagcagaaauggacggagcaaaaggacgacugagcagcggccaccugaagugcagacucaaaauggacaagcuccgccucaaaggagucagcuacagccucugcaccgccgcguucaccuucacaaaaauaccagcggaaacacuucacggaacgguaacaguggaaguacaauacgccggaacagacggacccugcaaagucccagcccagauggccgucgacaugcaaaccuuaaccccagucggccgccuaaucaccgcaaaccccgucaucaccgaauccaccgaaaacuccaaaaugaugcuggaacuagacccacccuuuggagacuccuacaucguuauaggaguaggcgagaaaaagaucacccaccacuggcaccgcuccggaagcacgaucggcaaagccuucgaagccaccguccggggagccaaacgcauggcaguacuaggagacacagcaugggacuucggaagcgugggcggggcccugaacagccuaggcaaaggaauccaccagauauucggcgccgccuucaaaagccuauucggcggcauguccugguucucgcaaauacuuaucggcacacuauuaauguggcucggacucaacacaaagaacggcucaaucagccuaaugugucucgcucugggaggaguccuaauauuccucagcacggcagucagcgcggacgucggcugcucagucgacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5091 - RNA, 2359 nt, Artificial Sequence
  KX447517.1 prME-long mRNA Design 1 opt
gggagaaagcuuaccaugcgcauaaucaacgcccgaaaagagaaaaagcgacgcggggccgacacgagcgucgguauaguaggccuacuucugaccacagccauggcggccgaagucacgcgccggggcagcgccuacuacauguaccuagaccgaaacgacgcaggagaagcaaucagcuucccaaccacgcuaggcaugaacaaaugcuacauacaaaucauggaccuaggucacaugugcgacgcaaccaugagcuacgaaugcccuaugcuagacgaaggagucgaacccgacgacguggacugcuggugcaacaccacaagcacaugggucgucuacggaaccugccaucacaaaaagggcgaagcacgcagaagccgacgcgccgucaccuugccaagccacagcacccggaaacugcaaacaagaagccaaacguggcuagaaagucgcgaauauaccaaacaucucauacgcgucgaaaacuggaucuuccgaaaccccggcuucgcacucgcagcggccgcaauagcauggcuccuaggguccagcacaagccaaaaaguuaucuaccucguaaugauccuacucaucgcuccagcauacuccauacgaugcaucggcgucagcaaccgagauuucgucgaaggaauguccggaggcaccuggguagacgucguacucgagcacggcggcugcgucaccgucauggcccaagacaaaccaacugucgacauagaacucgucaccaccaccgucucaaacauggccgaagugcgcagcuacugcuacgaagcgagcaucagcgacauggccagcgacuccagaugucccacucaaggagaagccuaccucgacaaacaauccgacacccaauacgugugcaaacgcacgcuagucgaccgaggauggggaaauggaugcggacucuuuggaaaagguucguuaguaaccugcgccaaauucgcaugcuccaaaaagaugacaggcaaaucaauacagccggaaaaccucgaauacagaaucaugcucagcguccacggcagccaacauagcggaaugaucguaaacgacacgggacacgaaacagaugaaaauagggcaaaagucgagaucaccccuaacaguccccgagccgaggcggcacuaggcggauucggaucacuaggacucgacugcgagccccgcacuggccuggacuucuccgaccucuacuaccucaccaugaacaacaaacacuggcuagugcacaaggaaugguuccacgacaucccccuacccuggcacgccggcgccgacaccggaacuccccauuggaacaacaaagaagcacuggucgaauuuaaagacgcacacgcgaaacgacaaacagucguaguacucggaucccaagaaggugccguccacacagcacuagccggagcgcuggaggcagagauggauggcgccaagggccggcucuccuccggccaccuaaagugucgucuaaaaauggacaaacuccgccuaaaaggcgugucguacagccuaugcaccgcagccuucaccuucaccaaaauccccgccgagacacuacacggaaccgucacagucgaaguccaauacgccggcacagacggcccgugcaaagugccggcccaaauggcaguggacaugcagacccuaacaccagucggacggcuaaucacagccaaucccguaaucacagaaagcacagaaaacagcaaaaugauguuagaacuagaucccccauucggcgacagcuacauagucauaggcgucggagagaagaaaauaacacaccacuggcacagaagcggcagcacaaucggaaaagcauuugaagcaaccguccgcggagcaaaaagaauggcaguacugggcgacaccgcaugggacuucggaucaguaggcggcgcacuaaacucauuaggcaaagggauacaccaaauauucggagcugcauucaaaagccucuucgggggcaugagcugguucucacaaacacucaucggcacccuacugauguggcugggacuaaauaccaaaaacggaagcaucucgcucaugugccucgccuuaggaggaguccuaaucuuccucagcaccgcuguaagcgccgacgucggcugcagcgucgacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5092 - RNA, 2359 nt, Artificial Sequence
  KU922923.1 prME-long mRNA Design 1 opt
gggagaaagcuuaccaugcgcauaaucaaugccaggaaagaaaagaaaaggcgcggcgcagaaaccucagugggaaucgucggacuacuacugaccacagcaauggccgccgaggugacacgacgcggaucugccuacuacauguaccuagaccgaaacgacgcuggcgaagcgaucuccuuccccacaacccucggaaugaauaaaugcuacauacaaauaauggaccuaggccacaugugugacgccacaauguccuacgaaugcccaaugcucgacgaagguguggaacccgacgacguggacugcuggugcaacacaacgucaacguggguaguauacggaaccugccaccacaagaaaggagaagcaagaagaagccgacgagcuguaacacucccgagccacagcacgcgaaaacuccaaaccagaagccaaacguggcuagaaagcagagaauacaccaaacaccuaauacgcgucgagaacuggauauuucgaaaccccggauucgcacucgcagccgccgcaauagccuggcuacuaggcaguucaaccagucaaaaagucaucuaccuaguuaugauacuacucaucgcacuagcauauagcauccgauguauaggggucucaaaccgcgacuucguagagggaaugagcggcggcaccuggguagacgucguccucgaacacggcggaugcguuaccguaauggcgcaggacaaacccaccguggacauagagcuaguuaccacgacaguaagcaacauggcggaagucagaucauacugcuacgaagcaagcaucagcgacauggcaagcgacagcagaugcccaacgcaaggagaagccuaccucgacaaacagagcgacacacaauacgucugcaaacgcacgcuuguagaccgaggauggggcaacggaugcggacuguucggaaaaggcucauuagucacaugcgccaaauucgcgugcagcaagaaaaugaccggaaaaaguauccaacccgaaaaccucgaauaccgaaucaugcucuccguccacggaucacagcacagcggaaugauaguaaacgacacaggacacgaaaccgaugaaaaccgggcgaaaguagaaaucacuccaaacuccccuagagcggaagccacacuaggcggcuucggaagccuaggccucgacugcgaaccacgcacgggccucgacuucagcgaccucuacuaccuuaccaugaacaacaaacacuggcugguacacaaagaaugguuccacgacaucccccuaccauggcacgcaggagcagacacaggcacaccccacuggaacaauaaagaggcacucgucgaguucaaagacgcccacgcaaaacgacaaaccgucgucguccuaggaagucaagaaggcgcgguccacacggcacucgccggugcgcuagaagcagagauggacggcgcgaaaggacgacuaagcuccggacaucucaaaugcaggcucaaaauggacaaacuccggcugaaaggaguaagcuacucgcucugcaccgcugccuucacauucaccaaaauccccgccgaaacacuccacggcaccgucaccgucgagguacaauacgcaggcacagauggaccgugcaaagucccagcacaaauggccguagacaugcaaacacugacacccgucggacgacucaucaccgcuaaccccgucaucaccgaaaguaccgagaacagcaaaaugaugcuagaacucgacccgcccuucggagacucauacaucguaaucggagucggggaaaagaaaauaacacaccauuggcaccgauccggcuccacuauaggaaaagcguucgaagccacgguacgcggugccaaacgaauggcaguccucggcgacaccgccugggacuucggaagugucggaggcgcauuaaacucccucggcaaaggaauacaccaaaucuucggcgccgcauucaaaagccuauucggaggaauguccugguucucccaaauacugauagggacacuccucauguggcucggucuaaacaccaaaaacggaagcaucucccucaugugccuugcccuuggaggaguacucaucuucuugucaacagccguaagugcugacgucggcugcagcgucgacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5093 - RNA, 2359 nt, Artificial Sequence
  KY003156.1 prME-long mRNA Design 1 opt
gggagaaagcuuaccaugcgaaucauaaacgcuaggaaagagaagaaacggcgaggagcggacacauccgugggaauaguuggccugcuccuaacaaccgcaauggcggcagaaguaacgcgccgaggcuccgccuacuacauguaccuagaccguaacgaugcuggggaggcaauauccuucccuaccacccucggcaugaacaaaugcuacauccaaauaauggaccucggacacaugugcgacgccacaauguccuacgagugcccgaugcuagacgaaggcgucgaaccagacgacgucgacugcuggugcaauacaaccagcaccugggucguauacggcacuugccaccacaagaaaggagaagccagacgcagcagacgagccgucacgcucccaagccacuccacccgcaaacuacagacccgaucccaaacauggcucgaaagccgagaauacacaaaacacuuaauccgcgucgagaacuggaucuuccgcaaccccggcuucgcacucgcagcggccgccauagccuggcuccucgggagcagcaccucccagaagguaaucuaccuggugaugauacuccuaauugcacccgccuacuccauacggugcauaggcauauccaaccgagacuucgucgaaggcaugucaggaggaaccugggucgacgucguucuagaacacggaggcugcguaaccgucauggcccaagacaaaccaacagucgacauagagcuagucaccacaaccgucuccaacauggccgaagucagaaguuacugcuacgaggcaagcaucagcgacauggccagcgacagccgcugccccacacaaggagaagcauaccucgauaaacaaucagacacccaauacgucugcaaacgcacacugguagacagaggauggggcaacggcugcggucucuucgggaaaggcucacugguaaccugcgccaaauucgccugcuccaagaaaaugacagggaaauccauacaaccagaaaaccuagaauaccgcauaaugcuaucuguccacggaucacaacacuccggcaugauaguaaacgacaccgggcacgaaaccgacgaaaacagagccaaaguagaaaucacccccaacagcccccgcgcggaagcaacacucggaggauucggcauacuaggacuggacugcgaacccagaaccggacuggauuucagcgaccuuuauuaccucacaaugaacaauaaacacuggcugguccauaaagaaugguuccacgacauacccuuacccuggcaugcgggagcagacacaggcacaccgcacuggaacaauaaagaagcccucgucgaguucaaagacgcccacgcaaaaaggcaaaccgucguaguccugggcucccaagaaggagccguacacaccgcacucgccggcgcccuagaagcagagauggacggggccaaaggccgacuaagcuccggccaccucaaaugccgucuaaaaauggacaaacuacgcuuaaagggcgugucauacucacucugcacagcagccuucacauucaccaaaauaccggcagaaacacugcacggcacagucacaguggaagugcaauaugccggcacagacggcccauguaaagucccagcccaaauggcaguagacaugcaaacgcuaacaccagugggccgccuaauaacagccaaccccgucaucacagaaaguacagaaaacucaaaaaugaugcuagagcuagaucccccauuuggcgacucauacauaguaauaggcgucggcgaaaagaaaaucacccaucacuggcaccgaucaggaagcacaauuggaaaagccuucgaagcgacaguaagaggagccaaacgaauggcaguacugggagacacagccugggacuucggaagcgugggcggagcacugaacucgcuaggaaaaggcauccaccagaucuucggcgcagccuucaagucacucuucggcggcaugagcugguucucccagauacucaucggcacgcuccucauguggcuaggacuaaacacgaaaaacgguagcaucucacugaugugccucgcccucggaggaguccucauauuccuaucgacagccguaagugccgacgugggaugcuccgucgacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5094 - RNA, 2359 nt, Artificial Sequence
  KU312313.1 prME-long mRNA Design 1 opt
gggagaaagcuuaccaugcgcaucauaaacgccagaaaagaaaagaaaaggcguggcgccgacacauccguaggaauagucggucuacuacucaccacagccauggcagccgaagucacaaggagaggcucagcauacuacauguaccucgaccgcaacgaugccggagaggccauuucauucccaacaacccuaggaaugaacaaaugcuacauccaaauaauggaccucggccauacaugcgacgccacaauguccuacgaaugcccuaugcucgacgaaggaguagaaccggacgacgucgacugcuggugcaacaccaccucaaccugggucguguacggaacaugccaccacaagaaaggagaagccagacgcagccgccgggcagugacccuccccucccacucgauccgcaaacuccaaacacgcagccaaaccugguuagaaucacgagaauacaccaaacaucuaaucagggucgaaaacuggaucuuccgaaacccaggcuucgcacucgccgcagccgcaauagcgugguuacucggaagcuccacaagccaaaaagucaucuaccucguaaugauacuucuaauagcaccagccuacagcauccgcugcaucggagucagcaaccgagacuuugucgagggcaugagcggcggcaccuggguggacgucguacucgaacacggcggcuguguuacggucauggcccaggacaagcccacagucgauauagaacucgucacuacaaccgucagcaacauggcugaaguacgaagcuacugcuacgaggccuccauaagcgacauggcaagcgacucccgcugccccacccaaggcgaagcauaccuugauaaacaauccgacacacaauauguaugcaaacgcacacucguagacagaggguggggaaacgggugcggacucuucggcaaaggaucccucguaaccugcgccaaauucgccugcuccaaaaagaugaccggaaagagcauccaacccgaaaaccucgaauaucggaucaugcucuccguccacggaucccaacauagcggaaugaucguaaacgacacagggcacgaaaccgacgaaaaccgcgcaaaaguagaaaucaccccgaacagcccccgcgcggaagccacccucgggggcuucggaagccugggccucgacugcgaaccccgaacaggacuagacuucuccgaccucuacuaccuaaccaugaacaacaaacacuggcucguccacaaagaaugguuccacgacauaccccuaccauggcacgcaggcgccgacacgggcacaccgcacuggaacaacaaagaggcauuagucgaauuuaaggacgcgcacgcaaaacgccagacaguagucgugcugggcucacaagaaggcgccguacacaccgcccuugccggcgcacuagaagcagagauggacggcgcaaaaggcagacuauccuccggccaccuaaaaugcagacuaaagauggacaaacuccggcugaaaggaguguccuacagccuuugcaccgcugccuucacguucacaaaaauccccgccgagacccuccacggaacgguaacaguagagguccaguacgcaggcaccgacggaccgugcaaagucccagcccaaauggccgucgacaugcaaacgcucacccccgucggccgacugauaaccgcgaacccagucaucaccgaguccaccgaaaacuccaaaaugaugcuagaacuagacccaccauucggggacucauacaucgugauaggaguaggcgaaaagaaaaucacccaccacuggcaucguuccggcuccacaaucggcaaagcauucgaagccacagucagaggcgccaaacgaauggccgugcucggagacaccgccugggacuucggaagcguaggcggcgcccucaacucccucggaaaaggaauccaccaaaucuucggggccgccuucaagucccucuucggcggaaugucaugguucucucagauacucaucggaacucugcucauguggcuagggcuuaacgccaagaauggcucgaucucacucaugugccuagcauuaggaggaguccucauauuccuaagcaccgcgguauccgcagacguagggugcagcgucgacuucaguaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5095 - RNA, 2359 nt, Artificial Sequence
  KY075935.1 prME-long mRNA Design 1 opt
gggagaaagcuuaccaugcgaauaauaaacgccagaaaagaaaagaaacgacgaggagccgacaccucaguaggcaucguaggacuacuacucacgacagcaauggcagcagagguaacccgccgcgggagugcauacuacauguaccuugacagaaacgacgcgggagaagcgauauccuucccaacaacgcucgggaugaacaaaugcuacauccaaauaauggaccucgggcauaugugcgacgcaacaaugucguacgaaugcccaaugcuagacgaaggcguagaaccagacgacgucgacugcuggugcaacacaaccagcaccugggucguauacggcacgugucaccacaagaaaggagaagcccaacgcuccaggcgagccgucacgcuccccagccacagcacccgaaaacuccaaacccgcagccagacauggcucgaaucaagagaauacaccaaacaccuaauacgagucgaaaacuggaucuuccgcaaccccggauucgcccucgcagccgcagcgauagcguggcuccugggcagcaguaccagccagaaaguaauauaccuugucaugauacuccucauagcccccgccuacaguauacgcugcauaggcguaagcaaccgcgacuucguagaaggaaugagcggcggaacaugggucgacguggucuuagaacacggcggcugugugacaguaauggcacaagacaagcccaccguagacauagaacuggucacaacaacaguaagcaacauggcagaaguccgcucguacugcuacgaggcuucaaucuccgacauggcaucagacucaaggugcccaacucaaggagaagcauaccucgacaaacaauccgacacccaauacgucuguaaacgaacacuugucgaccgcggaugggggaacggaugcggccucuucgggaaaggaucccucguaaccugcgccaaauucgcgugcucgaagaaaaugacgggaaaaagcauacagcccgaaaaccuugaauacagaauaaugcucagcguccacggaucacaacacagcggcaugauagucaacgacacaggccacgaaaccgaugaaaaccgggccaaaguagaaaucacgccaaacuccccacgagccgaagcgacacucggaggcuucggaucccuggggcuagacugcgaaccucgaacaggcuuggacuucagcgaccuguacuaccuaacaaugaacaacaaacacuggcugguacacaaagaaugguuccacgacaucccacuccccuggcacgccggagcagacaccggaaccccucacuggaacaacaaagaagcacucgucgaguucaaagacgcacacgccaaaagacaaacaguagugguccucgggagccaagaaggagcaguacacacagcccucgcaggcgcccucgaagcagagauggacggagcaaaaggacgccugagcucaggacaccuaaaaugcagacuaaaaauggacaaacuccgacuaaaaggcgucucuuacucacuauguacagcagcguuuaccuucacaaaaaucccagcggaaacauuacacggaaccgucaccgucgaaguacaauaugccggaaccgacggcccaugcaaaguccccgcacaaauggcagucgacaugcaaacacucacccccgucggacgccugaucacagcgaacccaguaaucaccgagucaacggagaacagcaaaaugaugcuagagcuggacccgccauuuggagauuccuacauagucaucggcgucggagagaagaaaaucacacaccacuggcaucgcagcggaagcacaauagguaaagcauucgaagcgacaguccguggagcaaaaaggauggcgguccucggcgauaccgcaugggacuucggcagcguaggcggagcccuaaacagccucggaaaaggcauacaccaaaucuucggcgccgccuucaaaagccuauucggcggaaugagcugguucagccaaauccuaauaggcacacuccucauguggcucggccucaacaccaaaaacggaagcaucagccucaugugccuagcccucggcggcguccuaaucuuccugucaacagccgugagcgcagacgucggcugcagcguggacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5096 - RNA, 2359 nt, Artificial Sequence
  KY014320.1 prME-long mRNA Design 1 opt
gggagaaagcuuaccaugcgcauuaucaacgcgcgaaaagagaaaaagagacgaggcgcagacaccuccguaggcaucgucggccuacugcucaccaccgccauggcagcagaagucaccagaagagguucagcguauuacauguaccucgaccgaaacgacgcaggggaagcaaucagcuucccaaccacccuaggaaugaacaagugcuacauacaaaucauggaccugggacacaugugcgacgccaccaugucauacgaaugcccgaugcucgacgaaggaguagaacccgaugacgucgacugcuggugcaacaccaccagcaccuggguagucuacggaaccugccaccacaagaaaggcgaagcacgacgcucgcgcagagcagucacccucccaucacacucaacaagaaaacuacaggccagaucacaaacauggcucgaaucccgagaguauaccaaacaccugauccgcgucgaaaacuggauauuccgaaaucccggcuucgcacuggccgccgccgccauagccuggcugcucggcagcagcaccagccaaaaagugaucuaccucgucaugauacugcucauagccccagccuacucaauacgcugcauaggaguaucaaacagagacuucgucgaggggaugucaggaggcaccuggguagacgucguccucgaacacggcggaugcgugacagucauggcccaggacaaacccacaguagacaucgagcuagucacaacaacagucucaaacauggccgaaguucgcucauacuguuacgaagccagcaucagcgacauggcgagcgacucacgcugcccgacccaaggagaagccuaccuggacaaacaguccgacacgcaguacgucugcaagagaacccuaguagacaggggcuggggcaacggcugcgggcuauucgggaaagguagccuuguaaccugcgccaaauucgccugcuccaagaaaaugaccggcaaaucgauccagcccgaaaaucuagaauaccgcauaaugcucuccgugcacggcagccaacacucaggcaugauuguaaacgacacuggccacgagacggacgaaaaccgcgcaaaagucgaaaucacaccaaacuccccacgcgcggaggcaacccucggaggcuucggaagccuaggccucgacugugaaccccgcaccggccuagacuucucagaccuuuauuaccucacaaugaacaacaaacacuggcucguucacaaagaaugguuucacgacaucccgcuccccuggcacgcaggcgccgacacaggaacaccccacuggaacaacaaagaagcccuagucgaguucaaagacgcacacgcaaaacgccaaaccgucgucguacucggcucgcaagaaggagcaguacacaccgccuuggcaggcgcccucgaagccgaaauggacggcgccaagggccggcucagcuccggccaccucaaaugccgccuaaaaauggacaaacuacgacuaaaaggaguaagcuacagccuaugcaccgcugcauucacuuucacaaaaauacccgcagaaacccuacacggcaccgucacggucgaaguucaauacgccggcaccgacggacccugcaaagucccagcccaaauggcaguagacaugcagacacucaccccagucggaagacuaaucaccgcaaacccaguaauaacagaauccaccgaaaacagcaaaaugaugcucgaacucgacccgccguucggagacagcuacaucguaaucggcguaggcgaaaagaaaauaacacaccacuggcaccgauccggcuccaccaucggcaaggccuucgaagcaaccguacgaggagccaaacgaauggcaguacucggagauacggcuugggauuucggcagcgucgggggagcccuaaacucacuaggaaaaggcauccaucaaaucuucggagcggcuuuuaaaagucuauucggaggcaugaguugguucagccagauacuaaucggcacacuacuaauguggcucggccucaacaccaaaaacggauccaucucacuaaugugucucgcccuaggcggaguacuaauauuccucagcaccgccgucagcgccgacguaggaugcaguguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5097 - RNA, 2359 nt, Artificial Sequence
  KX827309.1 prME-long mRNA Design 1 opt
gggagaaagcuuaccaugcgcaucaucaacgcgcgcaaggagaagaaacgccgaggcgcagacacauccgucggaaucguagggcuacuccucacaaccgcaauggccgcagaagugacacgacgcggaucugcauacuauauguaccuagacagaagcgacgcaggagaagcaauuagcuucccaacgacccucgggaugaacaaaugcuacauacaaauaauggaccucggacacaugugcgacgcaacgaugucuuacgaaugccccaugcuagacgaagggguggaacccgacgacgucgacugcuggugcaacaccacaagcacguggguagucuacggaaccugccaccacaagaaaggcgaagcccgcaggagcaggagagccguaacacuccccucccacagcacccgaaaacugcaaacgagaucacaaacguggcucgaauccagagaauauacaaaacaccuaaucagagucgagaacuggauauucagaaacccagguuucgcccuagcagcagcagcaauagccugguuacuaggaagcagcaccagccaaaaaguaauauaccuaguaaugauacuccucauagccccagcauacagcauacgguguaucggaguaagcaaccgagacuucgucgaaggaaugucgggaggaacauggguagacguaguacucgaacacggcggcugcguaacagucauggcccaagacaaaccaacaguagacauugagcuagugacuacaacagucagcaacauggcggaaguccgcucguacugcuacgaagcaucgaucagcgacauggcaagcgacaguagaugccccacacagggcgaagccuacuuagacaaacaaucagacacccaauacguauguaaaaggacccuagucgaucgcggauggggcaacggaugcgggcuauuuggcaaagguucacucguaaccugcgcgaaauucgcgugcaguaagaaaaugacaggcaaaaguauacaaccagaaaaccucgaguaccgcauaaugcuaucgguccacggcucccaacacagcggcaugaucgucaacgacacgggacacgaaaccgacgaaaacagagcaaaagucgagaucacaccaaacucaccacgagcagaggcaacccuuggcggauucggcagucucggacucgacugcgaaccgcggacaggccucgacuucucagaccuauauuaccuaaccaugaacaacaaacacuggcuaguacacaaagaaugguuccacgacauaccacuaccauggcacgccggcgccgacaccggcacaccacacuggaacaacaaagaagcacucguagaguucaaagacgcgcacgcgaaacgacaaacaguaguaguacuaggcucacaagaaggagcaguccacacagcacuggccggcgcacuagaagccgaaauggacggcgcaaaaggacgucuaaguagcggucaccuaaaaugccgacuaaaaauggauaaacuacgccuaaaaggggucucauacucgcucugcaccgcagcauucaccuuuacgaaaaucccagccgaaacccugcacgggacaguaaccguagaaguccaauacgccggcaccgacggcccaugcaaaguaccagcccaaauggccgucgacaugcaaacccugaccccggugggaagacugaucacagccaacccagucaucacagaaagcacggagaacagcaaaaugaugcuggaacuugacccacccuucggcgacagcuacaucguaauaggggugggagaaaagaaaauaacacaucacuggcaccgcucagguagcacaaucggcaaagcauucgaggcaacagucagaggagcaaaacggauggcaguccuaggagacacagccugggauuucggaagcguaggaggggcgcucaauucacuaggcaagggcauccaccaaauauucggagccgccuucaagucacuguucggcggaaugagcugguucagccaaauccucaucggcacacuauuaaugugguuaggacugaacacuaaaaacggauccaucagccucaugugccucgcgcugggcggcguacugauauuccugagcacagccguaagcgccgacgucgggugcucaguagacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5098 - RNA, 2359 nt, Artificial Sequence
  KU681081.3 prME-long mRNA Design 1 opt
gggagaaagcuuaccaugcgcauaauaaacgccagaaaagaaaagaagagaaggggaacagacacauccgugggcaucgucggccuccugcucacaacagccauggcagccgaagucacccgaagaggcagcgcauacuacauguaccuagacaggucagacgcaggcgaagcaauauccuucccaacaacacuaggaaugaacaaaugcuacauccagauaauggacuuaggacacaugugcgacgcaacgaugucauacgaaugccccauguuagacgaaggaguugaaccagacgacguggacugcuggugcaacacuacaucaacgugggugguguacggaacaugccaccacaagaaaggagaagcgcgcagauccagacgagcagugacccuaccaagccauagcacccgaaaacuccaaacaagaagccaaaccuggcuggagagcagggaauauaccaaacaccucauaagggucgagaacuggauauucagaaacccaggcuucgcacucgccgcagcagccauagccuggcuccuaggcucaagcacaagccaaaaaguaauauaucucgugaugauccuacuaaucgcaccagcauacucaauacgcugcaucggcgucaguaacagggacuucguagaagggaugucgggaggcacauggguggacguuguacucgagcacggaggaugcgucaccgucauggcacaagauaaacccacaguggacaucgaacucguaacuaccacagugucuaacauggcagaaguacgaucauacugcuacgaagcgucgauaucagacauggccagugacucccggugcccgacacaaggagaagcauaccucgacaaacagagcgacacacaauacguauguaaaagaacgcugguagaccgcggauggggcaacggcugcggacucuucggcaaaggaucccucguaaccugcgcaaaauucgcgugcucaaagaaaaugaccggaaagagcauacaaccagaaaaccucgaguaccgcauaaugcucucaguccacggaagccagcacagcgggaugauagucaacgacacaggccacgaaacagacgaaaaucgagcaaagguagaaaucacaccgaacagcccccgcgccgaagccacgcuaggaggauucggcucccuaggacucgacugugaaccgcgcacaggacuagacuucuccgaccuauacuaccucacaaugaacaacaaacacuggcuagugcacaaggaaugguuccaugacauaccccuccccuggcacaccggagccgacaccggaacaccacacuggaacaacaaagaagcccugguagaguucaaagacgcacacgcaaaaagacaaacaguagugguccuaggcagucaagaaggcgcuguacacacagcacuagcaggagcacuagaagccgaaauggacggcgcaaaaggaagacugucgucaggacaccucaagugccgauuaaaaauggacaaacuaagacugaaaggagucucguacagccucuguaccgcggccuucacauucaccaagauaccagccgaaacacugcacggaacaguaacaguagaagugcaguacgccgggacggacggaccaugcaaagugccagcacaaauggccguagacaugcaaacacucacgccagucggccgccugaucaccgccaaccccgucauaacagaagggaccgagaacucgaaaaugaugcuggaguuggacccacccuucggagacagcuacaucguaaucggagugggcgagaaaaagauaacgcaccacuggcaccgcaguggaagcaccaucggcaaagccuucgaagccaccguccgcggcgcaaagagaauggcaguccuaggcgacacagcaugggacuucggaagcguaggaggcguucugaacagccuaggcaaaggaauccaccaaaucuucggcgcagccuucaaaucacucuucgggggcaugucaugguucagccaaauacuaauaggcacccuacucauguggcucgggcuaaacacuaaaaacggaagcaucagccuaaugugccucgcccugggaggcguacuaaucuuccuaagcacagcaguuucagccgacgugggaugcagcgucgacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5099 - RNA, 2359 nt, Artificial Sequence
  KU744693.1 prME-long mRNA Design 1 opt
gggagaaagcuuaccaugcgaauaauuaacgcuagaaaagaaaagaaaagacgaggagccgauacauccguagggauugucggacuacuccuaacaacagcgauggcggcagaagugacacggcguggcagcgccuacuacauguaccuggaccgaaacgacgcaggcgaagccaucucauucccaacaacacuuggcaugaauaaaugcuacauccaaauaauggaucuaggccacaugugcgacgcgacaaugagcuacgaaugcccaaugcuagacgaaggcgucgaacccgacgacguggacugcuggugcaacaccaccuccaccugggucguguacgggaccugccaccacaagaaaggagaagcccgacgcucaagacgcgcgguaacacuaccaucacacucaacccgaaaacugcaaacccgcagucagaccuggcucgagucgcgagaauacacaaaacaccugauacgaguagaaaauuggaucuuccgaaacccgggauucgcccucgccgccgccgcaaucgccuggcuccuaggauccuccacaagccaaaaagucaucuaccucguaaugauccuccuaaucgcaccagccuacagcauaagaugcauaggaguaagcaauagagacuucgucgaaggaaugucaggcggcacauggguagacgucguacuagagcacggaggaugcgucaccgcaauggcccaagacaaaccaacaguagacaucgaauuagucacaacaacaguguccaacauggcagaaguacgcucauacugcuacgaagccagcaucagcgacauggcgagcgacucccggugccccacgcaaggcgaagccuaucucgacaaacagucagacacccaauacgucugcaaacgaacuuuaguugaccgcggcuggggcaacggaugcggccucuucggcaaaggaucacucgucacgugcgcgaaauucgccugcagcaagaaaaugacagggaaaucaauucagccugaaaaccuagaauaccgcaucauguuaagcguccacggaucacagcacuccggcaugcucgugaaugauacaggccacgaaaccgacgaaaauagagcgaaagucgaaaucaccccgaacucuccacgggcagaagcaacacuaggcggcuucggcucccucggacucgauugcgagccccgcaccggacucgacuuuagugaccucuacuaccucacaaugaacaacaaacacuggcucgcacacaaagaaugguuccacgacaucccgcuacccuggcacgccggagcagccaccggcacaccccauuggaauaacaaagaagcacucgucgaguucaaagacgcacacgcgaaacgccaaacagucguagucuuaggaagucaggaaggcgccguccacaccgcucucgccggcgcccucgaagccgaaauggacggcgccaaaggccgacucuccagcgggcaccuaaaaugccgacucaaaauggacaaacucagacucaaaggcguaucauacagccucugcacagcagcauucaccuucacaaaaauccccgcugaaaccguugacggcacaguaaccguagaaggccaauacgggggcaccgacggccccugcaaaguccccgcgcaaauggcgguagacaugcaaacccucacgcccguaggccgccucauaacagccaaccccgugaucacagaaucaacggaaaacagcaaaaugaugcuagaacuggaucccccauucggagacucauacauagugaucggugucggagaaaagaaaaucacccaccacuggcaccgcucaggcucaacaauuggaaaagccuucgaagcaacagucagaggcgcaaaacgcauggccguccugggagacacagccugggacuucggcucagugggcggcgcccucaacucccucgggaaaggcauccaccagaucaucggagcggccuucaaaagccuauucggcggaaugucaugguucagccaaauacuaauaggaacacuacuaauguggcuaggacucaacaccaaaaacggcaguaucucacucaugugccuagcccucggcggagucuuaaucuuccucucaacagcuguaucaggcgggguaggcugcuccguagacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5100 - RNA, 2359 nt, Artificial Sequence
  KY328290.1 prME-long mRNA Design 1 opt
gggagaaagcuuaccaugcgaaucauaaacgcacgcaaagaaaagaaacgacgagggacggacaccuccgucggaaucguaggccuccuucugaccaccgcaauggccgccgaagucacccgccgaggcucugcauacuacauguaccucgaccgcagcgaugccggagaagcgaucucauuccccacaacacucggcaugaacaaaugcuacauucaaaucauggaccucggacacaugugcgacgccacaauguccuacgaaugccccaugcuagaugaaggcgucgaaccagacgaugucgacugcuggugcaauacaaccagcaccugggucguguacggcacaugccaccacaagaaaggggaagccagacgcagccgacgagcagucacacuaccgucacacagcacacguaaacuccaaacccgcagccaaacauggcuggaguccagagaguacaccaaacaccugauaaggguagaaaacuggauauuccgcaacccuggcuucgcccucgccgccgcagcaaucgccuggcuacucggcucaucgaccucccaaaaaguaaucuaccucgucaugauacuucucaucgcccccgcauacuccauccgaugcauaggaguguccaaccgcgacuucguggaaggcauguccggcggaaccugggucgacguaguacuagaacacggaggaugcguaacggucauggcacaagacaaacccacaguugauauagagcucguaaccaccaccgucagcaacauggccgaaguacgcucauacugcuacgaagccuccaucucggacauggcuagcgauucccgcugccccacacaaggagaagcguaccuggacaaacaaucggacacacaauacguaugcaaacggacccuagucgaccgcgguuggggcaacggcugcggacuuuucggaaaaggaagccucguaacaugcgccaaauucgcaugcucgaaaaagaugaccggcaaaagcauacaaccagagaaccucgaguacagaauaaugcucucaguccacggcucccagcacuccggcaugauugugaaugacacgggccacgaaaccgacgagaaucgcgcuaaggucgaaaucacacccaauucaccacgcgcggaggccacacucggcggguuuggaagccucggccucgacugcgaacccagaacaggacuagacuucagcgaccuguacuaccucaccaugaacaauaaacacuggcuaguccacaaagaaugguuccacgacauccccuuaccauggcaugcaggcgccgacaccggcacaccccacuggaacaacaaagaagcccucguagaguucaaagacgcacacgccaaacgacaaacaguagugguacugggaucucaggaaggagccguacacacagcccuagcaggcgcauuagaagccgaaauggacggagccaaaggucgccucucuagcggacaucucaagugccgccugaaaauggacaaacucagacuaaagggagucucuuacucauuaugcaccgcagccuucacauuuuccaagaucccagccgaaacacugcacggcaccgucaccgaggaaguacaguacgccggaaccgacggcccaugcaagguaccagcccaaauggcggucgacaugcaaacacuaacccccgucggccgacucauuacagcuaaccccguuaucacagaaucaaccgaaaacucgaaaaugaugcuagaacuagacccacccuucggagacuccuacaucgucaucggcguaggcgaaaagaaaauuacacaccacuggcaccgcaguggcagcacgauaggaaaagcauucgaagcaacuguccgcggagccaaacgcauggcaguccucggggacaccgcaugggacuucggaagcgucggaggcgcccucaacucgcucggaaaaggaauccaccaaauuuucggagcagcguucaagucccuguucgggggcaugagcugguucagccaaauacucauaggaacacuacucaugugguuaggcuuaaacacuaagaauggcagcaucagccucaugugccucgcccuaggcggaguacucaucuuccucagcacagccgugagcgccgacguaggcugcagcgucgacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5101 - RNA, 2359 nt, Artificial Sequence
  KX694532.2 prME-long mRNA Design 1 opt
gggagaaagcuuaccaugcgcauaaucaacgcccggaaagaaaagaaacgacgaggcacugacaccuccgucggaauagucggacuacuacuaacuacagccauggccgcagaagucacaaggcgcggaucagcauacuacauguaccuagaccgcucagacgccggcgaagccaucagcuucccaaccacacuaggaaugaacaaaugcuacauacagauaauggaccugggacacaugugcgacgccacaaugagcuacgaaugcccaaugcuagacgaaggcguugaacccgacgacguagacugcugguguaacacgaccagcaccugggucguauacggaacaugccaccacaagaaaggcgaagcuaggcgcucccgacgcgccgucacccuaccgagccauuccaccagaaaacuccaaacgaggucccagaccuggcuggaaucccgagaauacacaaaacaccuuauacgaguagaaaacuggauauuccgaaacccgggguucgcccuggccgccgcugccauagccuggcuccucggcuccuccacaagccaaaaaguaauauaccugguaaugauccuacuaauagcccccgccuacagcaucaggugcaucggcgucucaaacagagacuucgucgaaggcauguccggcggaaccuggguggacguaguccuggagcauggcggaugcgugacaguaauggcccaagacaagccaaccguagacaucgaacugguaacuacaaccgucagcaacauggccgaaguccgaagcuacugcuacgaagccagcauaagcgacauggccuccgacucccggugcccaacacaaggcgaagccuaccuagacaaacaauccgacacgcaauacguaugcaaacgaacccuagucgacagaggauggggcaacggcugcggccucuucggcaaaggaucacucgucacgugcgccaaguucgccugcaguaagaaaaugacaggcaaaucgauacaacccgaaaaccuagaauaccgcaucaugcuaagcguacacggcagccaacacucaggaaugaucgugaacgacacaggccacgaaacagacgaaaaucgagcaaaaguagaaaucaccccuaacagcccacgugccgaagcaacacuaggaggauucggcagccuaggccuugacugugagccacgaaccggacucgacuucuccgaccuguacuaccucacgaugaauaacaaacauugguuaguccacaaagaaugguuccacgacauaccauugccauggcacgcaggcgcggauaccggaacgccacacuggaacaacaaagaagcacucgucgaguucaaagaugcacacgcaaaaagacagaccguagucguacuuggcagucaagaaggcgccguccacaccgcgcuugccggagcccuagaagccgaaauggacggcgccaaaggccgacucuccuccggacaccucaaaugccgacugaaaauggacaaacuccgacucaaaggcguaagcuacagcuugugcaccgccgccuucacauucacaaaaauaccagcagaaacucuccacggcaccguaaccguagaaguacaguacgccgggacagacggccccugcaagguaccagcacaaauggccgucgacaugcaaacccuaacacccguuggcagacuaaucacagcgaacccaguaaucaccgaaagcaccgaaaauagcaagaugaugcucgaacucgaucccccauucggcgacagcuacauagucauaggagucggcgagaagaaaaucacccaccacuggcaccgaagcggcagcaccauaggaaaagccuucgaagccacagugagaggcgcgaaaagaauggcaguccucggcgacacagcgugggacuucggcagcgucggcggcgcacucaacucacucggcaaaggcauccaccaaaucuucggcgcagccuucaaaagccucuucggcggcauguccugguucagccaaauacuaaucgggacccuacugauguggcuaggacuaaacaccaaaaacggaucgaucucccucaugugcuuagcacucggcggcguccuaauauucuuaagcaccgccguauccgcagacgugggcugcagugucgacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5102 - RNA, 2359 nt, Artificial Sequence
  KU955593.1 prME-long mRNA Design 1 opt
gggagaaagcuuaccaugcgaauaaucaacgcacgcaaagagaaaaagagaagaggaacagacacaucagucggcaucgucggauuacugcucacgacggcaauggcgguagaggugacccgcaggggaaacgccuacuacauguaccuagacagaagcgacgcaggagaggcuaucuccuucccgaccacaaugggcaugaacaaaugcuacauccaaaucauggaccuagggcauaugugcgacgcaaccaugagcuacgaaugcccaauguuagacgagggagucgaaccagacgacguugacuguuggugcaauaccacaagcaccugggucguauacggcacaugccaccacaagaaaggggaagcgaggcgcagucgacgcgccgucacccuacccagccauuccacacgcaaguuacaaacgcgcagccaaacguggcuagaaagccgagaauacaccaaacacuuaaucagagucgaaaacuggaucuucagaaacccgggauucgcacuagcagccgccgcgaucgccuggcuacuagguucgagcacaagccaaaaagucaucuaccuagugaugauacuccuaauagcccccgcauacagcauacgguguauaggcguaucaaacagagauuucgucgagggaauguccggcggaacauggguagacguaguacuggaacacggcggaugcguaacagucauggcacaggacaaacccacagucgacauagaacucgucaccaccaccgucagcaacauggccgaaguacgcagcuacugcuacgaggcaucaauauccgacauggcauccgacagcagaugcccaacgcagggagaggccuaccuagacaaacaauccgacacacaguacgugugcaaaagaacccuaguagaccgagguuggggcaacggcugcggacuauucgggaaaggcucgcuaguaaccugcgccaaauucgccugcagcaagaaaaugaccggcaaaucaauucaaccagaaaaccucgaauaccgaaucaugcucagcguccacggaagccaacacagcggaaugauaguaaacgacaccggccacgaaacagacgagaacagagcgaaagucgaaauaacacccaacaguccccgcgcagaagccacccugggaggauucggcagccucggccuagacugcgaaccacgaacaggacuagacuucagcgaccuguacuaccugacaaugaacaacaaacauuggcuaguacacaaagaaugguuccacgacauaccacucccuuggcacgcuggcgccgacacaggaacaccccacuggaacaacaaagaagcccuagucgaguucaaagaugcacacgcaaaacgccaaaccguagugguccugggcucacaggaaggagccgugcacacagccuuagcgggcgcgcucgaagccgaaauggacggagccaaaggcagauuaagcagcggacaccucaaaugccggcugaaaauggacaaacugcgacucaaaggaguauccuacagccucuguacagcggccuuuacauucacaaaaauaccagcggaaacgcuucacgggacaguaacaguugaaguacaauacgcuggaacagacggacccugcaaaguaccggcacagauggccgucgacaugcaaacccuaaccccaguaggacgccugauaacggccaacccagugaucaccgaaagcaccgaaaacucaaaaaugaugcucgaacucgacccgccauucggcgacagcuacauagucauaggagugggagaaaagaaaauaacgcaccacuggcaccgcagcggcaguacaaucggaaaagccuucgaagcaaccgugcgcggcgcaaaaagaauggccguacuaggagacaccgcuugggacuucggcagcguaggcggagcccucaacagccucgggaaggggauccaccaaaucuucggagcagccuucaagagccuuuucggaggcauguccugguucagccagauacuaauagggacccuacugguauggcuaggucucaacaccaaaaacggcagcauaagucuuaugugccucgcacuaggcggaguacuaauauuccuaagcacagcagugagugccgacguaggcugcagcguagacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5103 - RNA, 2359 nt, Artificial Sequence
  KY272987.1 prME-long mRNA Design 1 opt
gggagaaagcuuaccaugcgaaucauaaacgcccgcaaagaaaagaaaaggagaggcacagacacaagcguaggaaucguggggcuccugcuaacaacagccauggcggccgaggucacccguagaggcagcgcguacuacauguaccuagaccgcagcgacgccggagaggccaucagcuucccgacaacccuaggcaugaacaaaugcuacauacaaauaauggaccucggccacaugugcgacgcgaccaugucauacgaaugcccaaugcuggacgaaggagucgaacccgacgacguagacugcuggugcaacacaacgagcacguggguagucuacggaaccugccaccacaagaaaggcgaagcacgacgaucccgacgagcggucacgcucccaagccacuccacccgaaaacuccagaccagaagccaaaccuggcuagaauccagggaauacaccaaacaccucauccgcguagaaaacuggauauuccgaaaccccggcuucgcacucgcagcagcagccauagcauggcuacucggcagcagcacaagccaaaaaguaauauaccuggugaugauacuacugaucgcccccgccuacagcauccgcugcauuggagucaguaacagagacuucguagagggcaugaguggaggaacauggguggacgucguccuggaacacggaggaugcgucacaguaauggcacaagacaaacccacagucgacaucgaacucguuacaacgaccgucucaaacauggccgaaguacgcagcuacugcuacgaggcaaguauaagcgacauggcaagcgacagccgaugcccgacccaaggagaagcauaccuggauaaacaaagcgacacgcaauacgucugcaaaagaacccuagucgaccgcggaugggggaacggaugcggacuauucggaaaagggagccucguaacaugcgcaaaauucgcgugcucaaagaaaaugacaggcaaaagcauccaaccagaaaaccuagaauaccgaaucaugcuaagcguacacggaucccaacacagcggaaugauagucaaugacacgggacaugaaacagacgaaaacagagccaaagucgaaauaacaccaaacaguccccgcgcggaagccacccucgggggauucggaagccucggcuuagacugcgagccgcgcacaggacuagacuucagcgaccuauacuacuuaaccaugaauaacaaacauuggcucguccacaaagagugguuccacgacaucccacuuccguggcacgccggcgcggacacaggcacaccgcacuggaacaacaaagaagcccucguggaguucaaagacgcccacgccaaacgacaaacagucguaguucuagggucccaagaaggcgcaguacacaccgcacucgcaggcgcccucgaggccgaaauggacggcgccaaaggccgacuguccagcggacaccucaagugcagacuaaaaauggacaagcuccgccuaaaaggcguaucauacucgcuauguacagcggcauucacauucaccaaaaucccagccgaaacccuccacggaaccguaacaguagaaguacaauacgcaggaacagacggcccgugcaaaguaccggcccaaauggcaguagacaugcaaacacucacacccgucggaaggcuaaucacagcaaacccagucauaacggaaagcacagaaaacagcaaaaugaugcucgaacuagacccaccguucggcgacagcuacauaguuauagggguaggagaaaagaaaauaacacaccauuggcauagauccggcagcacaaucgggaaagcauucgaagcgacagucagaggagcuaaacgaauggccguacucggcgacacagccugggacuucggauccgugggcggggcccugaacagucucggcaaaggaauccaccaaaucuucggagccgcauucaaaucgcuauucggcggcauguccugguucucccagauccuaaucggaacccuauuaauguggcucgggcuaaacaccaaaaacggauccauuucccugguaugccucgcccucggaggaguacucauauuccugagcacagccgucagcgccgauguaggaugcuccguggacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5104 - RNA, 2359 nt, Artificial Sequence
  EU545988.1 prME-long mRNA Design 1 opt
gggagaaagcuuaccaugcgcauaaucaacgcaagaaaagaaaagaaacgccgaggcacagacaccagcgugggcauagucggacuacuccuaacaaccgccauggccguugaagucacacgacgaggaagcgcauacuacauguaccuagaccguagcgacgccggagaagcaauauccuucccaaccacccuaggaaugaacaaaugcuacauccaaauaauggaccuaggccauaugugcgacgcuacgaugaguuacgaaugccccaugcuggacgaaggcguagagccggacgacgucgacugcuggugcaacaccaccagcaccuggguagucuacggaaccugccaccacaagaaaggcgaggcacgcagaagccgccgagcagucacccuaccaucccacucaacacgcaaacuacaaacaagaucccaaaccuggcuggaaagccgcgaauacacaaaacaccugauacgagucgagaacuggaucuuccgaaacccaggcuucgcccucgccgcagccgccaucgcguggcuacucggcagcuccacuagccaaaaagugauauacuuaguaaugauacuccucaucgccccagccuacucgauccgcugcaucggcgucagcaauagggauuuuguagaaggcaugagcggcgguacuugggucgacgucgugcuagagcacggcggcugcgucacaguaauggcacaagacaaacccgccgucgacaucgaacucguaacgacgacaguaucaaacauggccgaagucagaucguauugcuacgaagccuccaucagcgacauggccagcgacucccgcugcccaacacagggagaagcauacuuagacaaacaaagcgacacacaauacguaugcaaacgaacccuagucgaccgcggaugggggaacgggugcggucuauucggaaaaggaucacucguaaccugcgccaaauucgcgugcagcaagaaaaugaccggcaaaucgauacaaccagaaaaccucgaauacagaaucaugcuauccguccacggcucccaacacucuggcaugaucguaaacgauaccggccacgaaaccgacgaaaaccgagccaaaguggaaaucaccccgaacagcccucgggcagaagccacgcugggcggguucgggagccuaggacucgacugugaaccacgcaccggacuagauuucagcgaccuauacuaccugaccaugaacaacaaacacugguuaguccacaaagaaugguuccacgacauaccacucccauggcacgcaggcgccgacacaggcaccccacacuggaacaacaaagaagcacugguagaguucaaagacgcccacgccaaacgccaaacggucguagugcuagggucacaggaaggcgcgguccacaccgcccucgccggcgcccuggaagcagaaauggacggugccaaaggacgccucagcucaggacaccuaaaaugccgacucaaaauggacaaacugcgccucaaaggggucucauacucacuaugcaccgccgccuucaccuucaccaaaaucccagccgaaacacuccacggaacaguaaccguggaaguccaguacgccggcaccgacggacccugcaaggugccagcacaaauggccguagacaugcaaacccucaccccagucggacgccuaauaacugccaaccccgucaucaccgaaagcacagaaaacucaaaaaugaugcuugaacuggaucccccauuuggcgacagcuacaucgucaucgggguuggcgaaaagaaaaucacacaccacuggcaucgcucaggcuccaccaucggcaaagcguucgaagccaccguccgcggcgcaaaacgcauggccguacugggagacaccgcaugggacuuuggaagugucggaggcgcccugaacucacuagggaaaggaauacaccaaaucuucggagcagcguucaaaagccucuucggcggaaugaguugguucagccaaauccuuauaggaacccuccucguauggcucggguuaaacaccaaaaacgggagcauuagccuuacaugccuagcccucggcggcguacucauauuccucagcaccgcugucucggccgacgucggcuguuccguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5105 - RNA, 2359 nt, Artificial Sequence
  KU681082.3 prME-long mRNA Design 1 opt
gggagaaagcuuaccaugcggaucaucaacgccagaaaagaaaagaaacggcgcggagcggacacaucagucgggaucguaggccuacuucucaccacggcaauggcagucgaaguaacaagacgcggaagcgccuacuauauguaccucgaccgcuccgacgccggagaagcaaucagcuuccccacuacccuaggcaugaacaaaugcuacauccaaaucauggaccucggacacaugugugacgccacgaugucauacgaaugccccaugcucgacgaaggaguggaacccgacgacguagacugcuggugcaacaccacaucaacauggguugucuacggaaccugccaccacaagaaaggagaagcccgucgaagccggcgagccguaacacucccuucgcacucaacccgaaaacugcaaacaagaucccaaacauggcuagaaagucgugaauacacaaaacaucuaauacguguggagaacuggaucuuccgaaaccccggauucgcauuagcagccgccgucauagccuggcugcuaggaagcagcaccagccaaaaaguaauauaccuggucaugauccuacucauagcgccagccuacuccaucagauguauaggcgucucaaaccgggacuucgucgagggaauguccggaggcacuugggucgacgugguacuggaacacggcggaugcgucacagucauggcacaagacaaaccaacuguagacauagaacucgucacgaccacggucagcaacauggccgaggucagaagcuacugcuacgaagccagcauuucagacauggcaagcgacagccggugcccgacccaaggagaagcguaccuagacaagcaaagcgacacccaauacgucugcaaaagaacccucgucgaccggggcuggggcaacggcugcggacucuucggcaaaggaagucuaguaacuugcgcaaaauuugcgugcucgaagaaaaugaccggcaaaucaauccaacccgagaaccuagaguacagaauaaugcuaucaguucacggcagucagcacuccggaaugaucguaaacgacaccggccacgaaaccgacgaaaaccgcgcaaaagucgaaauaacacccaacagcccccgagccgaagccacacucggaggguucggcucccuaggacuagacugcgagccacgcaccggacucgacuucucagaccuauacuaccuaaccaugaacaacaaacacuggcucguccacaaagaaugguuccacgacauaccgcuccccuggcacgccggagcggacaccggcacaccccacuggaacaacaaagaagcccuagucgaguucaaagacgcacaugcaaaacgccaaaccguagucguacucggcagccaggaaggggccgugcacacagcccuagcaggagcccucgaagccgaaauggacggagccaaaggacgacucucaagcggccaccucaaaugccgacuaaaaauggacaaacuacgacuaaaaggcgucagcuauagccugugcaccgcagccuuuaccuuuacuaagauucccgcggaaacccuacauggcaccgucaccguagagguacaauacgccggcaccgacggcccaugcaaaguccccgcccaaauggccgucgacaugcaaacgcucacaccagucggaagacuaauaacagccaaccccgucaucaccgaaaguaccgaaaacaguaaaaugaugcuagaacucgauccacccuucggagacucauacaucgucaucggagucggcgaaaagaaaauaacacaccauuggcauaggucgggcuccacaauaggaaaagcauucgaagccaccguccgcggugcaaaacgaauggcaguccuaggggacacagcaugggacuucggcagcgucggaggugcacuaaacucccucggcaaaggcauccaccaaaucuucggcgcagccuucaaaucccuguucggaggcauguccugguucagccaaauccucaucggcacccuauuaguauggcuaggccucaacacgaaaaauggcucgauaucacuaacaugucucgcccuaggcggaguccucaucuuccuaagcaccgccguauccgcagacgucggaugcuccguagacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5106 - RNA, 2359 nt, Artificial Sequence
  KX601167.1 prME-long mRNA Design 1 opt
gggagaaagcuuaccaugcgaauuauaaacgcccgcaaagagaagaaaagacgcggagccgacacauccguggguaucgucggacuccuccuaaccaccgccauggccgucgaaguaacccgacgcggauccgcguacuacauguaccuugaccgcucagacgcgggggaagccauaucuuuucccaccacacuaggagucaacaaaugcuacauccaaaucauggaccuaggccacaugugcgacgccacaaugagcuacgagugccccaugcucgacgaagggguugaaccagacgacguugacugcuggugcaacaccacguccaccuggguugucuauggaaccugccaccacaagaaaggcgaagcccgccggucccgccgagccgucacccugcccagccacagcacacgcaaacuacaaacccgaucucaaacauggcuagagucacgagaauauacaaaacaccucauccgagucgaaaauuggaucuuccgcaacccaggcuucgcgcucgccgcagccgccaucgcauggcuccucggauccucaaccucacaaaaaguuauauaccugguaaugauauuacucauagcaccagccuacucaauacgaugcauaggagucuccaaccgcgacuucgucgagggcaugagcggaggcaccuggguagacgucguccuagaacacggaggcuguguuaccgucauggcgcaagacaaacccacagucgacaucgaacucguaacaaccaccgucuccaauauggcggagguacgaucauauuguuacgaagcaucaauaucagacauggcgagcgacagucgcugcccgacccaaggcgaagccuaucuugacaaacaaagcgacacacaguacguaugcaaacgaacacucguagaccgaggcuggggcaacggcuguggccuguuuggcaaagguagccugguaacaugcgcaaaauucgccugcuccaagaaaaugaccggcaaaucaauacaacccgaaaaccuagaauaccgcaucaugcuguccguccacggcagccaacacagcggcaugaucgucaacgacaccggacacgaaaccgacgaaaaccgcgccaaaguagagauaacaccuaacucaccccgagccgaagccacacucggaggcuuuggcagccuaggacucgacugcgaaccccgaacaggacucgacuucuccgaccuauauuaccuaacaaugaacaacaaacacuggcuaguacacaaagaaugguuccacgacauaccacuacccuggcacgccggagccgacaccggaacaccccacuggaacaacaaagaagcacucgucgaguucaaggacgcacacgccaaacggcagaccgucguuguccuaggcucacaagaaggcgcgguccacaccgcucucgcaggcgcccucgaagcagaaauggacggcgccaaggggaggcucuccuccggacaccucaagugccgccuaaaaauggacaaacuacggcucaaaggaguaagcuacagccucugcacagcagcauucacauucaccaaaauaccagcagaaacgcuacauggaacagucacggucgaaguacaauacgcgggcacagacggacccugcaaagugcccgcacaaauggcgguugacaugcaaacccuuacgccagucggccgacucaucaccgccaaccccgucauuacagaauccacagaaaacuccaaaaugaugcuugaacuggacccacccuucggcgacucguacauaguaauaggcgucggcgacaagaaaaucacccaccacugguaccgcuccggcucaacaaucggaaaagcauucgaagcaaccguccgaggugccaaacguauggcaguacuaggcgacaccgccugggacuucggcuccguaggaggagcacucaacucccucggaaaaggaauccaucaaauauucggagccgccuucaagucccuauucggcggcaugucaugguuuagccagauccucauaggaacccugcuaguauggcuaggccucaacaccaaaaacgggucaaucucuuuaaccugccuagcauuagggggaguucucauauuccucagcacagcaguaagcgccgacguaggcuguuccgucgauuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5107 - RNA, 2359 nt, Artificial Sequence
  KX694533.2 prME-long mRNA Design 1 opt
gggagaaagcuuaccaugcgcauaaucaacgcacgcaaagaaaagaaaagacgcggagcagacacaagcgugggaauuguaggccugcuauuaaccacugccauggcgguagaaguaacacgacgcggaucagcauacuacauguaccuggacagaagcgacgcuggcaaagccaucuccuucccaacaacgcugggaguaaacaaaugcuacauccaaauaauggaccuagggcacaugugcgacgccacaaugagcuacgaaugcccgaugcucgacgagggaguagaaccagacgacgucgacugcuggugcaacacaacuagcacauggguaguauacggcaccugucaccacaagaaaggagaagcacgccggagccgacgggcagucacgcuacccucacacagcacacgaaaacuacaaacucgcucccaaaccuggcucgaaagccgagaauacaccaaacaccuaauccgcgucgagaacuggaucuuccgcaacccaggauucgcacuagcagcugcagcaaucgcguggcugcucggaagcagcacaagccaaaaaguaauauaccuaguaaugauacuccucaucgcccccgccuauaguauacggugcaucggcgucagcaaccgagacuucgucgaaggcaugagcggcggcacgugggucgacgucguccucgaacauggcggaugcgucacaguaauggcccaggacaaaccaaccgucgacaucgaacuugucacaacgaccgugagcaacauggccgaaguccgcuccuacugcuaugaagccuccaucucagauauggccucagacagccgaugcccaacccagggcgaggcauacuuggacaaacaaagcgacacccaauacgucugcaagcgaacacuggucgaccgagggugggguaauggaugcggccuauucggcaagggaagccuagucaccugugcaaaguucgccugcucaaagaaaaugacagggaaauccauccaacccgaaaaccucgaguaccgcauaauguugagcguccacggcucccaacacagcggcaugauaguaaacgacaucggccaugaaaccgacgaaaaucgagcaaaaguagaaauaacaccuaacaguccgagagcggaagcaacacuaggaggcuucggcucgcuaggccuagacugcgaaccccgaaccggacucgacuucagcgaccuauacuaucucacuaugaacaacaaacacuggcucgugcacaaagagugguuccacgacaucccgcuccccuggcacgcaggagccgacacaggcaccccacacuggaacaacaaagaagcgcuagucgaguucaaagacgcacacgcuaaaagacaaaccguggucguccuaggcucacaagaaggcgcaguacacacagcacuagccggcgcucucgaagcagaaauggacggagccaaaggucgacuauccuccggccaccuaaaaugccgccucaaaauggauaaacuccgccucaaaggcguaucauacagucuaugcaccgccgcauucacauucacaaaaauaccagccgaaacccuccacggcaccguaaccguagaaguacaguacgcaggaaccgacggaccaugcaaagugccagcccaaauggcagucgacaugcaaacacucacuccagucggacgacuaaucaccgcuaaccccgucauaaccgagagcacggaaaauuccaagaugaugcuagaacuggaucccccguucggcgacagcuacauagucaucggagucggagacaagaaaaucacacaccacuggcaccgaagcggcagcaccaucggaaaagcguucgaagcaaccgucagaggcgccaaacgaauggccguacucggagacacggccugggacuucggcuccgucggcggagcacucaauucccucggaaaagguauccaccaaauuuucggcgccgcauucaaaucacuauuugggggcauguccugguucucgcagauacuuaucggcacccuccuaguauggcuaggacuaaacaccaaaaacggcagcauaagccucacaugccuagcccucggagggguccuaauauuccugagcacagccguaagcgcugacgucggcugcagcgucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5108 - RNA, 2359 nt, Artificial Sequence
  KY288905.1 prME-long mRNA Design 1 opt
gggagaaagcuuaccaugagaaucaucaacgcaagaaaagaaagaaaaagaagaggcgccgacacaucaaucggcaucgucggccugcuacuaacaacagcuauggcagcagaaaucacccgacgaggcucagcguacuacauguaccucgacagaagcgacgccggaaaagcuaucagcuucgccacgacacugggagucaacaagugccacgugcagauaauggaucucggacacaugugcgacgcaaccaugaguuaugagugccccaugcuagacgaaggcguagagccagacgacguagacugcuggugcaacacaacaagcaccuggguaguauacggcacaugccaccacaagaaaggagaagcaagacgaagcaggcgcgcaguaacacuacccucacacagcacacgaaaacuccaaaccagaagccagacauggcucgagagccgugaauacacaaaacaccuaauaaaaguggaaaacuggauauuccgcaacccaggguucacccuaguagccguagcaaucgcguggcuucucgggagcagcaccucccagaaagucauauaccucguaaugauccuucucauagcuccggccuacagcauacgaugcauaggcguaagcaaccgcgacuucgucgaaggaaugucagggggaacauggguggacguaguacuagaacacggaggcugcgucacgguaauggcacaagacaaaccaaccgucgauaucgagcuagucaccaccacagucagcaacauggcggaaguacgaagcuacugcuacgaagccucaaucagcgacauggcgagcgacucucgcugcccaacacaaggcgaagcauaccucgauaaacaaagcgacacgcaguacgucugcaaacgcacccucgucgacagaggguggggcaacggguguggccuauuuggaaagggaucauuagucacaugcgcaaaauucacaugcagcaagaaaaugacagggaaaagcauccaaccugagaaccucgaauaccgcauaaugcucagcguccauggaucacaacacuccggcaugaucgucaacgacacgggacacgaaacagaugaaaaucgagcgaaaguagaggucacaccgaauagccccagagccgaagccacacuaggaggauucggaagccucggccuggacugcgaaccgcgaaccggccucgacuucagcgaccuauacuaccucaccaugaacaacaaacauuggcuaguccacaaagaaugguuccacgacaucccccuccccuggcacgcaggcgccgacacgggaaccccucacuggaacaacaaagaagcacugguugaguucaaagacgcacacgccaaaagacaaacaguaguaguauuagggagccaggaaggagccguacacacagcccucgcaggcgcccuagaagccgaaauggacggagccaaaggcagacuguucagugggcaccucaaaugcaggcuaaaaauggacaaacuacgccuaaaaggcguaagcuacagccuaugcacagccgcauucaccuucacaaagguccccgcggaaacacugcaugggacgguaacaguagaagugcaauacgcaggcacagauggacccugcaaaguaccagcacaaauggccguagacaugcaaacacuaacacccgucggaagacucaucaccgcaaacccagucaucacggaaucaacagaaaacagcaaaaugauguuagaacuggacccacccuucggcgacucauacauaguaauaggcgucggagacaagaaaaucacgcaucacuggcaccgcagcggcagcacaauuggcaaggcauucgaagcaacagucagaggagcgaaacgaauggcaguacucggcgauacagccugggacuuuggauccgugggaggcguguucaacagccucggaaaagguauccaccaaaucuucggcgcagcguucaaaucacuauucggcggcaugagcugguucagccaaauacucaucggaacacuccuaguauggcuaggacucaacaccaaaaacggcagcaucagccugacaugccuagcgcucggaggagucaugauauuccucucaaccgcagugucggccgacguagggugcagugucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5109 - RNA, 2359 nt, Artificial Sequence
  KF268950.1 prME-long mRNA Design 1 opt
gggagaaagcuuaccaugagaauaaucaacgcccgcaaagagcgcaaaagaaggggagcagacacgagcauaggcaucaucggacuccugcucaccaccgcaauggcagcagaaaucaccagaagaggaucagccuacuacauguaccuggacagaagcgacgcgggaaaagcaauauccuucgcaacgaaucuaggcgucaacaaaugccacguacagaucauggaccuaggucauaugugcgacgccaccaugucauacgaaugcccaaugcuagacgaaggcgucgaaccagacgacgucgacugcuggugcaacaccacguccaccugggugguauacggcacaugccaccacaagaaaggcgaagcccgaaggagcagacgcgcugucacccuaccaagccacaguacgcgcaagcuccaaacaagaagccagaccuggcuagaaagccgcgaauacacaaagcaccuaaucaaagucgaaaacuggaucuuccgaaacccaggauucgcccucgcagccgucgcaaucgcauggcugcuaggaagcuccaccagccaaaagguaaucuaccuggucaugauccuacugaucgcacccgccuacucgauucgaugcaucggcguaucgaaccgcgacuucgucgaagguaugagcggcggaaccugggucgacgucguacuagaacauggcggcugcguuacaguaauggcacaagauaagcccaccguagacaucgaacucgucaccacgaccguaagcaacauggcagaaguccgcucuuacugcuacgaagcaagcaucagcgacauggcaagcgacucacgauguccaacccaaggggaagcauaccucgacaagcaaagcgauacacaauacguaugcaaaaggacccucgucgaccgaggcuggggaaacggaugcggacucuucggcaaaggaagccuaguaacaugcgccaaauuuacaugcagcaagaaaaugacaggcaaaaguauccagccagaaaaccucgaauaccgcaucaugcuuagcguacacggcagccaacacucaggaaugaucgucaacgacauaggacacgaaaccgacgaaaacagggcgaaaguagaagucacacccaacuccccacgagcagaagcuacccugggcggauucgggagccugggccucgacugugaaccgagaacaggacuagacuucagcgaccucuacuaccucacaaugaacaacaaacacuggcuggugcacaaagaaugguuccaugacauaccgcucccauggcacgcaggagccgacacaggaacaccgcacuggaacaacaaagaagcccuagucgaguucaaagacgcacacgcgaaaaggcagacagucgucguccugggaucacaggaaggcgcaguacacacagcacucgccggcgcguuagaagcagagauggacggugccaaaggacgacuguuuucagggcaccucaaaugccggcuaaaaauggacaaacugcgccucaaaggaguaucauacagcuuaugcaccgccgccuuuaccuucaccaaaguccccgcagaaacccuccacggcaccguaacaguggaaguacaauacgcagggaccgacgggccaugcaagguaccugcacaaauggccgucgacaugcaaacacucacacccgucggaagacuaaucaccgccaacccaguaauaacagaaagcacagaaaacagcaaaaugaugcuagaacuagacccaccauuuggagacagcuacaucgugaucggagugggcgacaagaaaauaacccaucacuggcaccgcucaggcagcacaauaggcaaagccuucgaagcaacagucagaggagcgaaaagaauggccguacugggagacacugccugggacuucggcuccgucggcgggguauucaacagccuuggcaaaggcgugcaccagauauucggggccgcguucaaaaguuuauucgggggaaugaguugguucucccaaauacuaauaggcacacuucuaguauggcucggacuaaauacgaaaaacggaagcauuagccucacaugcuuagcccucggcggaguuaugauauuccucaguacagcagugucagccgacgugggaugcuccguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5110 - RNA, 2359 nt, Artificial Sequence
  KF383121.1 prME-long mRNA Design 1 opt
gggagaaagcuuaccaugcgcaucauaaacgcacgcaaagaaaggaaacgcagaggagcggacaccuccauaggaauaauaggccuacuacucacaaccgccauggcggccgaaaucacgcgacgaggaucugcguacuacauguaccuggaccgcagcgaugccggaaaagccaucuccuucgcaacgacgcucggagucaacaagugccauguacaaauaauggaccucggucacaugugcgacgccacgaugucauacgaaugcccgaugcucgacgaaggcguagaaccagacgacgucgauugcuggugcaacacaacgagcacaugggucguauacggcacuugccaccacaaaaagggagaagcacgccgcagccgccgagcagucacacugccaucccacagcacgcgcaaacuacaaaccaggagccaaacguggcuagaaagcagagaauacacgaaacaccugaucaaagucgaaaacuggauauuccgaaaccccggauucgcccugguagcaguagcaaucgcauggcuacuaggcuccagcacaucccaaaaggucauauaccuaguaaugauacuacucaucgcaccagccuacagcauaagaugcaucggcguaagcaaccgcgacuucgucgaaggaauguccggcgggaccuggguugacguaguacucgaacacggcggaugcgucaccgugauggcacaagacaaacccacgguagacaucgaacucgucacaacgacagucagcaacauggcggaagugcguucguacugcuacgaagccagcauaucagacauggcauccgacucaagaugcccaacacaaggcgaagccuacuuagacaaacaaucagacacccaauacgucugcaaacggacacuugucgaccgcggauggggaaacggaugcggacuauucggaaaaggcucgcuagugacaugcgcaaaguucacaugcucaaagaaaaugacaggcaaauccauacaaccagaaaaccuugaauaucgaauuaugcucagcguccacggcucccaacacucaggaaugauagucaacgacauaggacacgaaacagacgaaaacagagccaaaguggaggucacaccaaacucccccagagcagaagcaacacuaggaggauucggaucccugggacuagacugcgaacccaggacaggccuugacuucuccgaccucuacuaccucaccaugaacaacaaacacuggcucguccacaaagaaugguuccacgacauaccccugcccuggcaugccggggcagacacagggacaccccacuggaacaacaaagaggcucugguagaguucaaagacgcgcacgcgaaaagacaaacagucgucguccucggcucccaggaaggcgccguacauacagcacucgcuggcgcgcuagaagccgaaauggacggcgcaaaaggcagacucuucuccggacaccuaaaaugccgacucaaaauggacaaacuacgacugaaaggcguauccuacagccuauguacagcagcauucaccuucacuaaaguaccagccgaaacccuacacggcacaguaaccguagaaguccaguacgcaggaacagacggccccugcaaaguaccagcacagauggcagucgacaugcaaacgcugaccccgguagggaggcucauaaccgccaacccaguuaucacggaaucaaccgaaaacagcaaaaugaugcucgaacuggacccacccuucggcgauucauacauaguaauaggaguaggcgacaagaaaauaacccaccacuggcacagauccggcagcaccauaggcaaagccuucgaggccacaguacgcggcgccaaaagaauggccguacucggagacaccgcaugggacuucggauccgucggaggcguauucaacagccucggcaaaggaauccaccaaauauucggagccgccuucaaaagccuauucggaggcaugagcugguucagccaaauccuaaucgggacgcuccuaguauggcuaggccucaacaccaaaaacggaagcaucagccuaaccugucuagcccugggcggcguaaugaucuuccuaagcaccgcggucagcgccgacguaggcugcagcguugacuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5111 - RNA, 2341 nt, Artificial Sequence
  KF268949.1 prME-long mRNA Design 1 opt
gggagaaagcuuaccaugagaauaaucaacgcaaggaaggaaaggaaaaggaggggcgcagacacgagcauagggauaaucggccuacuacugacaacagcgauggccgccgaaauaaccaggaggggcagugcauacuacauguaccuggacagaagcgacgccgggaaagcgaucucguucgcgacuaaccucggcgucaacaagugccacgugcaaauaauggaccucggccacaugugcgacgcaaccaugucguacgaaugcccgaugcuagacgaaggaguggaacccgacgacguagacugcuggugcaacacaacgagcaccuggguaguauacggaaccugccaccacaagaaaggcgaagcgcgccggagccggcgagcggucacacucccaagccauagcacacgaaaacuccagacccgcagccagacauggcuagaaagcagagaauacacaaagcaccugaucaaagucgaaaacuggauauucagaaacccaggguucgcacuagcagcgguagccaucgccuggcugcuaggcagcuccacuagccagaaggucauauaccucguaaugaucuuacucaucgcgccagcauacucaauaaggugcaucggcgugagcaaccgcgacuucgucgaaggcaugucgggaggaaccugggucgacgucguccuagaacacggcggcugcgucacaguuauggcacaggacaagcccacaguagacauagaacucgucacaacaaccgugagcaacauggccgaaguacgaagcuacugcuaugaagcgucaaucucagacauggcaucagacagccgaugccccacacagggggaagcauaccucgacaagcaaagcgacacccaauacguauguaaacgaacccucgucgacagaggaugggggaacggauguggccuauucggaaaaggcagccucgugaccugcgcaaaauuuaccugcucaaagaaaaugacgggaaagagcauccaacccgaaaacuuagaauacagaaucaugcuauccguccauggaucccaacacagcggcaugauagucaacgacgaaaacagagccaaaguggaggucacgccaaacagcccaagagccgaagccacccucggcggauucggcagcuugggccuagauugcgaacccaggaccggacuagacuucuccgaucuuuauuaccugaccaugaacaacaaacacuggcuaguacacaaagaaugguuccacgacaucccacuaccauggcacgcaggagcagacacagggaccccgcacuggaauaauaaagaagccuuggucgaguucaaagacgcacacgcgaaacgccaaaccguaguaguacuaggcucccaagaaggugcgguccacaccgcucuagccggagcccucgaagcagaaauggacggcgccaaaggccgacuguucucaggccaccuaaaaugucgacuaaaaauggacaaauuacgccucaaaggcguaaguuacucgcucugcacagcggcauucaccuucaccaaagugccagccgaaacuuuacacggaaccguaaccgucgaaguacaauaugcgggaacagacggacccugcaaaguuccagcucaaauggcggucgacaugcagacgcucacccccgucggccgacucauaaccgccaaccccgucauaacugaaagcacagaaaacucaaagaugauguuagaauuagacccacccuucggcgacucauacaucguaauaggcguaggagacaagaaaauaacccaccacuggcaccgaucagguagcacgauagguaaagcauucgaagccacagucagaggcgcaaaacgcauggcagugcugggcgacacagcgugggacuucggauccgucggcggaguauucaacucacucgggaaagggauccaccaaauauucggagccgcauucaaaucccuauucggcggaaugagcugguucucccaaauacuaauaggcaccuuauugguauggcuagggcucaacaccaaaaacggaagcauaagccugaccugccuagcacucggaggagucaugauauuccucagcaccgcagucagcgcagacgucggaugcagcguggacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5112 - RNA, 2359 nt, Artificial Sequence
  KU955595.1 prME-long mRNA Design 1 opt
gggagaaagcuuaccaugagaauuaucaacgcccgaaaagaacgcaagcggcgaggcgcagacaccucaauaggaaucgucggccuacuacuuaccacagcgauggcggcagaaaucacacgacgcggcagugcauacuauauguaccuagaccgcucagacgccggcaaagcaaucaguuucgcaaccacccucggcgucaacaagugccacguccaaauuauggaccuaggccacaugugcgacgccaccauguccuacgaaugccccaugcuugacgaaggagucgaacccgacgacgucgacuguuggugcaacaccacaagcaccugggucgucuacggcacaugucaccacaagaaaggcgaagcgcgaaggagcagacgagcgguaacccuaccaucccauuccacccguaaacuucaaacacgcagccaaaccuggcucgaaagccgagaauacacaaaacaccuaaucaaagucgaaaauuggauauuccgcaacccgggguucgcucuagucgccguggccauagccuggcuccuaggcuccucaacgucacaaaagguaauauaccucgucaugauacuccuaaucgcaccagcguacagcauccgaugcauaggcgucagcaaccgcgacuucguggaggggaugagcggaggcaccuggguagaugucguacucgaacauggaggcugcgucacagucauggcacaagacaagccaacaguggacauagaacucgucacaacgacgguuagcaacauggccgagguacgaagcuacugcuacgaggccagcauaucagacauggccagcgacucaaggugccccacccaaggggaagcauacuuggacaaacaauccgacacccaauacgucugcaaacggacccugguggaccgaggguggggcaacggcugcggccucuucggaaaagguucccucguuacaugcgccaaauuuacgugcagcaagaaaaugaccggaaaaucaauacaaccugaaaaccucgaauacagaauaaugcucagcguccacggcucgcaacacagcggaaugaucguaaacgacaccggacacgaaaccgacgaaaaccgcgccaaagucgaagucacaccaaacuccccacgcgccgaagccacacucggcggauucgguagccuaggacuggacugcgaaccacgcacaggacuagacuucuccgaccucuacuaccuaaccaugaacaacaaacacuggcucguccacaaagaaugguuccacgacauaccccucccauggcaugcgggcgccgacaccggcacaccccacuggaacaacaaagaagcucuaguagaguucaaagacgcacacgcuaaacgccaaaccgucguaguccuuggcucccaagaaggcgcuguacauaccgcccuagcuggugcccucgaagcagaaauggacggagccaaaggacgccuguucuccggccaccucaaaugccgccucaaaauggacaaacuccgccucaaaggaguaucauacucccuaugcaccgcagcuuucacguucacaaaagugccagccgaaacacuacacggaacagugaccgucgaaguccaauacgccggcaccgacggacccugcaaaguacccgcccagauggccguagacaugcagacccuuacccccgucggaagacuaaucaccgcaaacccagucaucaccgaaucaacagaaaauagcaaaaugaugcucgaauuagacccacccuucggcgacucauacaucgucauuggcguaggcgacaagaaaauaacccaccacuggcacaggucagguuccaccaucggcaaagcauucgaagccaccguacgaggcgccaaacgcauggcaguccuaggagacaccgcgugggacuucggcagcgugggaggaguuuucaacucccucggaaaaggaauccaccaaaucuuuggcgcggcauuuaaaagucuauuuggaggaaugagcugguucucacaaauucugauaggcacccuccucgucuggcuaggucuaaacaccaaaaacggcaguaucucacuaaccugccucgcacuaggagggguaaugaucuuccucaguaccgcagucuccgcagacguugggugcagcgucgacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5113 - RNA, 2359 nt, Artificial Sequence
  KF383116.1 prME-long mRNA Design 1 opt
gggagaaagcuuaccaugcgaauaaucaacgcgaggaaagaacgaaagagacggggcgcggacacauccauaggcauaguagggcugcugcuaacaacggcgauggcagccgaaauaacaagaaggggaagcgccuacuacauguaucucgaccgaucggacgccgggaaagcaaucagcuucgcaaccacccucggaguuaacaaaugccacguacaaaucauggaccuaggccacaugugcgacgccacaaugagcuacgaaugcccaaugcuggacgaaggcguggaacccgacgacgucgacugcuggugcaacacgacaagcaccuggguggucuacggcacaugccagcacaagaagggggaagcccgacgauccagacgcgcggucacacugccaagccacuccacccgcaaacuacagacaaggagccaaaccuggcucgaaagccgagaauacaccaaacaucucauaaaaguagagaacuggauauuccgaaacccuggguucgcccucgucgcgguggcaaucgcauggcuacuaggauccagcacgagccaaaaagucauauaccuaguaaugauacucuuaaucgcgccagcauacucaauccgaugcauaggcgucuccaacagagauuucgucgaaggaauguccggcggcaccuggguagacgucgugcuagaacauggaggcugcguaacaguaauggcacaagacaaaccaacagucgacaucgagcucgugacaacaaccguaaguaacauggcggaagugcgcucguacuguuacgaagccagcaucucugacauggcaagcgauagcagaugcccaacgcaaggcgaagcguaccucgacaagcaauccgacacacaguauguaugcaagaggacauugguagacagagguugggguaacggaugcggacuguucggaaaaggcucgcuaguaaccugcgccaaauucacaugcaguaagaaaaugacaggcaaaagcauacagcccgagaaccucgaauacaggauaaugcucucagugcacggaagccaacacagcggaaugauaguaaacgacauuggccacgaaacugacgagaacagagcaaaaguagaagugacacccaacagcccaagggcggaggcaacacuaggcggauucggcagccuaggccuagacugugaaccgcgaacaggccucgacuucagcgaccuauacuacuuaaccaugaacaacaaacacugguuggugcauaaagagugguuccacgacauaccacuuccauggcacgccggagcagacacagggaccccacacuggaacaacaaagaagcacuggucgaguucaaagacgcgcacgccaaacgacagacaguagucguccugggaagucaagaaggcgcgguacacaccgcacucgcaggcgcccuagaagccgaaauggacggcgccaaaggaaggcuguucaguggccaccuaaaaugcaggcucaaaauggacaaacuucgacugaaagggguaagcuacucguugugcaccgccguaugcacagccgccaaaguacccgcggaaacacuacacggcacggugacaguggaaguccaguaugccgggaccgacggacccugcaaggucccagcccaaauggcaguagauaugcaaacccucacgcccguagggcgacuaauaaccgcaaacccaguaauaacagaaucgacagaaaacagcaaaaugaugcuggaacucgacccgcccuucggagacagcuauauaguaauaggggucggagacaagaaaauaacacaccacuggcaccggagcggaagcacaauugggaaagcauucgaagcgacagugcggggagcuaaaaggauggcgguacuaggagacaccgcaugggauuucgggagcgucggcgggguauucaacagccuagggaaaggcauacaucaaauauuuggcgcagcuuucaagagccuauucgggggcaugagcugguucucacaaauacuaauaggaacccuccuagucuggcucgggcucaacacaaagaauggaucaauaagccuaacaugccuugcucucggaggcgugaugauauuccuaucaacagcggugagcgcggacgugggaugcuccguagacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5114 - RNA, 2341 nt, Artificial Sequence
  KU963574.2 prME-long mRNA Design 1 opt
gggagaaagcuuaccaugcgaauaauaaacgcccgcaaggaaagaaaacgcaggggcgccgacgccucaauaggaaucgucucacuccuacucacaacagugauggccgcagagaucacgcgcagaggauccgcauacuacauguaccuagacagaagcgacgcaggaaaggcaauauccuucgucacaacccucggcgugaacaaaugccacguccaaauaauggaccuaggccacaugugcgacgccacaaugucauacgagugcccaaugcuggacgaaggcgucgaaccggacgacgucgacugcuggugcaacacaacguccacauggguagucuacggaaccugccaccacaagaaaggcgaagcacggaggagccggcgcgcaguaacauuaccaucacacaguacccgaaaacuccaaaccagaucccaaaccuggcuagagagccgcgaauacaccaaacaccuaaucaaaguggaaaacuggauauucagaaaucccggauucgcacucgucgccguagccaucgcauggcuacugggauccagcacaagccaaaaaguuaucuaccucguaaugauacuccugaucgcacccgcauacucaauaagaugcauaggcguaagcaaccgcgacuuuguagaaggaaugagcggagggacgugggucgacgucguacuagagcacggaggaugcgucaccgugauggcccaggacaaacccaccgucgacauugaacucgucacgaccacaguaagcaacauggccgaaguacggucauacugcuacgaagccucaauaagcgacauggcaucagacucacgcugcccaacacaaggggaagccuaccuagauaagcaauccgacacccaauacguaugcaaacgcacccuagucgaccgcggaugggggaacggaugcggacuauucggcaaaggaucgcuggugaccugcgccaaauucacaugcucaaagaaaaugaccgggaaaagcauccaaccagaaaaccucgaauaccguauaaugcuaucaguccacggcucucaacauucaggcaugaucgucaacgacgagaaccgcgcaaaaguagaggugacccccaacuccccaagagcagaggcgacccucggaggauucggcucacugggccuagacugcgaaccccgcaccggcuuagacuucagcgaccucuacuaccuaaccaugaacaacaaacacuggcuaguacacaaagaaugguuccacgacauaccacuucccuggcauucaggggccgauaccgaaaccccgcacuggaacaauaaagaagcccucguagaguucaaggacgcgcacgccaagagacagacagucguaguccuuggaagccaggaaggcgccguacacacugcccucgccggagcauuagaagccgaaauggacggcgcgaaaggccgacuaucaucuggccaccugaaaugccggcucaagauggacaagcugcgucucaagggagugucauacucacucugcacagccgcauucacauucaccaagguccccgcugaaacccuccacggaaccgugaccgucgaaguccaauacgccggacgagacggaccuugcaagguucccgcccagauggccgucgacaugcaaacccuaacacccgucggcagacuaaucaccgccaaccccgucaucacagaaucaacagaaaacucaaagaugaugcuagaacuagacccaccauucggggacagcuacauaguaauaggcgucggagacaagaaaaucacgcaccacuggcaccgcagugggucaauaauaggcaaagcguucgaagccacgguccgcggagccaaacgcauggcaguacuaggcgacaccgccugggacuucggaagcgucggaggcguguucaacucacucggcaaaggaauacaucaaauauucggcgcugccuucaaaucucuauucggagguauguccugguucucacaaauacuaaucggaacccuccucgucuggcucggacuuaacaccaaaaacgggagcaucucacugaccugccucgcccucggcggcguaaugaucuuccuaagcacagcaguauccgcagacgucggcugcagcguagacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5115 - RNA, 2341 nt, Artificial Sequence
  KX601166.1 prME-long mRNA Design 1 opt
gggagaaagcuuaccaugcgcaucauaaacgcccgcaaagaaagaaaaagaagaggagccgacaccaguaucggaauaguuggacuccuccuaacaaccgccauggccgccgaaauaacccgccgcggcagcgcuuacuacauguaccucgacaggagcgaugcaggcaaagccaucucauucgccacaacuuugggcguaaacaaaugccacgugcaaaucauggaccucggccacaugugcgacgccacuauguccuacgaaugccccaugcucgacgaaggcguagaaccugacgacguagacugcuggugcaauacaaccagcaccuggguagucuauggaacaugccaccacaagaaaggugaagcacgccgaucacggagagccguaacccuacccucucacagcacccgcaaacuacaaacccgcucccaaacauggcuagagucacgcgaguacaccaaacacuuaaucaaaguggaaaacuggaucuuccguaaccccggcuucgcccucgucgcagucgccauagccuggcuccucggcucauccacaucccaaaaagucauauaccuaguaaugauacuccuuauugcaccagccuacagcaucagaugcaucggcgucucaaaccgagauuucgucgagggcaugucuggaggaaccugggucgacguaguccucgaacacggaggcugcgucaccguaauggcccaagacaaaccaacaguugacauagagcuagugaccaccacagugagcaauauggccgaaguucgauccuacugcuacgaagccagcaucucagacauggccagugacucucgcugccccacccaaggagaggccuacuuagacaaacaaagcgacacacaauacgucugcaagcgcacccucgucgaccgcggauggggaaacgguugcggauuauucggcaaaggcucucucguuaccugcgcgaaauucaccuguuccaagaaaaugaccggcaaaagcauccaacccgaaaaccuagaauacaggauaaugcucagcguccacggcucgcaacacuccggaaugaucgucaacgaugaaaaccgggccaaagucgaagucacgccgaacucaccaagagcugaagcuacacuaggcggcuucggaagccucggccuggacugcgaaccccgcacaggccucgacuucucagaccucuacuaccucaccaugaacaacaaacacuggcucguacacaaagaaugguuccacgacauaccccucccauggcacgcaggcgcagacacaggcacaccccacuggaacaacaaagaagcacucguggaguucaaagacgcccacgcaaaacggcaaacagucgucguacuaggcagccaagaaggcgcuguccacaccgcacuugcaggcgcccucgaagccgaaauggacggagcuaaaggcagacucuucagcggccaccuaaaaugccgccucaagauggacaaacugcgacuuaaaggcgucucguacucccuaugcacagcagccuucaccuucacaaaggucccggcggaaacacuacacgggaccguaaccgucgaaguacaauacgcaggaaccgacggccccugcaaaguacccgcacaaauggcggucgacaugcaaacacugacccccgucggacgccugauaaccgccaaccccgucauaaccgagucaacagaaaacagcaaaaugaugcucgaacuagacccucccuucggcgauucuuacaucgucauaggagucggcgacaagaaaaucacacaccacuggcacagauccgguucaacaaucggcaaagcauucgaggccaccguccgcggcgccaaacgcauggcagucuuaggcgacaccgccugggacuucggcagcguaggcggaguauucaacagucucggcaaaggcauccaccaaauauuuggcgccgcguucaaaagccuguucgggggcauguccugguucucccaaauccucauaggaacccuccuaguauggcuuggacuaaacaccaaaaacggcuccauaucccuaaccugccucgcucucggcggggugaugauauuccucagcacagcaguguccgccgacgucggcugcuccguugacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5116 - RNA, 2359 nt, Artificial Sequence
  KF383118.1 prME-long mRNA Design 1 opt
gggagaaagcuuaccaugcgaaucauaaacgcaagaaaagaaagaaaaaggagaggcgccgacaccucaaucgguauaaucggccuacuccucacaacggccauggccgcagaaaucacaagacgaggcuccgcauacuacauguaccucgaccguucagacgcgggcaaagcaauaucauucgccacaacccucggaguaaacaaaugccacguccaaauaauggaccuaggacacaugugcgacgccacuaugagcuacgaaugcccaaugcuagacgaaggagucgaacccgacgacgucgacugcuggugcaacaccaccucgaccuggguaguguacgggaccugccaccacaaaaagggggaaacccgaagaucccggaggagugugagccuaagguaccacuacacacgaaaacuccagaccagaagccaaaccuggcuggaauccagagaauacaagaaacaccucauaaugguagaaaacuggauauucagaaacccaggauucgcgauagucagcguggcaaucacauggcuaaugggaagccucaccucccaaaaaguaauauacuuagugaugaucguccucauaguaccagccuacagcaucagcugcaucggagucagcaaccgcgacuuagucgaggggaugucgggcgggacaugggucgacguaguacucgaacauggaggcugcguaacagaaauggcacaagacaaacccaccguagacaucgagcucguaaccaugacagucucaaacauggccgagguccggucguacugcuacgaggcgucccugucagauauggcaagcgccuccagaugcccuacccaaggcgaaccaagucucgacaaacaaucagacacccaaagcguaugcaaaagaacacucggagacagggguuggggaaauggcuguggaauauucggaaagggaagccuaguaacaugcaguaaguuuaccugcugcaagaagaugccaggaaaaucaauacaaccagaaaaccuggaauaccgaauaaugcuccccguacacgguucacagcacagcggcaugaucguaaacgacauuggacacgaaacagaugaaaacagggccaaaguggaagugacaccgaacagcccacgcgcagaagccacccucggaggcuucggcucacucggacuggacugcgaaccacguacggggcuugacuucagcgaccucuacuaccugacgaugaacaacaaacacuggcuaguacacaaagagugguuccaugacauaccccuacccuggcacgccggcgcagauacaggcacgccucacuggaacaacaaggaggcacucgucgaguucaaagacgcccacgcaaaaaggcaaaccguagucgugcucggcucccaggaaggagcaguacauacagcacuggccggagcccuagaagcagaaauggacggagccaaaggacgccucuucucaggccaccugaaaugcaggcucaaaauggacaaacugagacucaagggcguaagcuacagccucugcacagcagccuucacauucaccaaagugcccgcagaaacacuccacggaacggucaccgucgaaguacaauccgccggaacagacggccccugcaaaguacccgcacaaauggcugucgacaugcaaacauuaacacccgucggacgacugaucaccgcaaauccgguaaucaccgaauccacagaaaauagcaaaaugaugcucgaacucgacccacccuucggagacagcuacauagucaucggcgucggugacaaaaagaucacccaccacuggcacaggagcggcagcacaauaggaaaagccuucgaagcaaccgugcgaggagcgaaaagaauggcaguguuaggcgacaccgccugggacuucggcucaguaggaggaguguucaacagccuaggaaaaggaauacaccaaaucuucggcgcggcauucaaaagucuuuucggaggaaugagcugguucagccagauauuaauaggcacccuccucguauggcuaggucuaaacaccaaaaacggcuccaucucacuaaccugccucgcgcuaggcggagucaugaucuuccucagcacagccgucuccgcagacguagggugcucagucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5117 - RNA, 2353 nt, Artificial Sequence
  KF383120.1 prME-long mRNA Design 1 opt
gggagaaagcuuaccaugcgcauaauaaacgcccgaaaagaacgcaaacgaagaggcgccgacacaucaauaggaauaauaggccuccucuuaacgacagcgauggcagccgaaauaaccaggagggguucagccuauuacauguaccuggaccgcagcgacgcaggaaaagccaucucguucgcaacaaccaugggagucaacaagugccacguacaaaucauggaccuaggacacaugugcgacgccacaauguccuacgaaugcccuaugcuagacgaaggcguagaacccgacgacgucgacugcuggugcaacaccaccagcacaugggugguauacggaaccugccaccacaagaaaggagaagcgagaccguccagacgagcgguaacacugccgagccacuccacccgcaaacuucaaaccaggucacaaacauggcucgaaagcagagaauauacaaagcaccuaaucaaagucgaaaacuggauccuccgcaacccaggauucacaguggcagcacuagcaauggccuggcuacugggaaacagcaccucacaaagagucaucuaccuagucaugauccuacuaaucgcccccgccuacucgaucaggugcaucggcguuagcaaccgggacuucguagaaggcaugagcggcggaacaugggucgacguagugcucgaacacggcgggugcgucacaguaauggcacaagacaaacccacagucgauaucgagcuagucaccacaacaguaagcaacauggccgaagucaggucguacugcuacgaagcaagcauaagcgacauggcaagugacagcagaugccccacccaaggggaagccuaccuagacaaacaauccgacacccaauacgucugcaagcgcacccuagucgacagaggguggggaaacggcugcggccuauucggcaaaggaucccuaguaacaugcgcaaaauuuaccugcagcaaaaagaugacaggcaaaucaauccaacccgaaaaccucgaauacagaaucaugcucucaguccacgguucacaacacucggggaugaucgucaacgauaucggacacgaaaccgaugaaaacagagcaaaggucgaagucacuccaaacuccccuagagccgaagcaacccucggaggauucggcucccucggccuagacugcgaaccacgcaccgggcucgacuucagcgaccuauacuaccuaacaaugaacaacaaacacuggcugguacacaaagaaugguuccacgacauaccacuaccuuggcacgcaggggccgacaccggcacaccccacuggaacaacaaagaagcgcuaguagaguucaaggacgcacacgcaaaaagacaaaccgucguaguacuaggaagccaggaaggcgcgguccacaccgcgcuggccggcgcacuagaagccgaaauggauggagcaaaagggcgccucuucuccggccaccucaaaugccggaucaaaauggacaaguuaagacuaaaaggcgucucauacagccuuugcacagcagccuucacauucucgaaagugccggcagagacacugcacggcaccguaaccgucgaaguacaauaugcaggcagagacggcccaugcaagguacccgcacaaauggcagucgacaugcagacacuaaccccagucggccgccuaauaacagcaaaccccaucaucacagaaagcacagaaaacucccgcaugaugcucgaacuagacccacccuucggcgacagcuacauaguaaucggggucggcgacaagaaaauaacacaccacuggcaccgaagugggagcacaaucggaaaagcauucgaagccacagucagaggagccaaacggauggcaguccucggcgacaccgcaugggacuucggaagcgucggaggcgucuucaacucauugggcaaaggaguccaccaaguuuuuggggccgcauucaaaagccuguucggagggaugagcugguucucgcaaauacuaaucggcacccugcucgucuggcucggccucaacacaaagaacggaucuaucucacuugcaugccucgcacucggcggcgccaugaucuuccuauccacggcagucagcgccgacguaggcuguagcguagacuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5118 - RNA, 2284 nt, Artificial Sequence
  KU321639.1 prME-short mRNA Design 1 opt
gggagaaagcuuaccaugacaucaguaggaauaguaggccugcuacucaccaccgcaauggccgcggaagucaccagaagagggagcgcauacuacauguaccuagacaggaacgacgcgggagaggccauaucauucccaacuacgcuagguaugaacaaaugcuauauccaaauaauggaccuagggcauaugugcgacgccacgaugaguuacgagugccccaugcuagacgaaggggucgaaccggacgacguagacugcuggugcaacacaaccucaaccuggguagucuacgggaccugccaccacaagaaaggcgaagcacgccgaucaagacgagcgguaacccucccaagccacucgacaagaaaacuccaaacccgaagucaaaccuggcucgaaucucgcgaauacaccaaacaccucauucgaguagaaaacuggaucuuccggaacccaggcuucgcguuagccgccgccgccauagcauggcuacuuggaagcuccaccucccaaaaagucauauaccuaguaaugauccuccucauagcgccagccuacuccauuagaugcauaggcguaagcaauagagacuucgucgaaggcaugagcgggggcacguggguugacaucguccuggagcacggcggcugcguaacaguaauggcccaagacaaaccaaccguugacaucgagcuagugacgacaaccguaucaaacauggcagaaguaagguccuacugcuacgaagcaagcaucuccgacauggcaucagacagcagaugcccgacacaaggagaagcauaccuagacaagcaaagcgacacccaguacguaugcaaaagaacgcuggucgaccgcggauggggaaacggaugcggccuauuuggcaaaggaagccuaguaaccugcgccaaauucgcaugcuccaaaaagaugacaggcaaauccauccaaccagaaaaccuagaauaucgaaucauguuaagcguacacggaagucaacacucaggcaugaucgucaacgacacaggacacgagacagacgaaaacagagcaaaagucgaaaucacaccaaauucaccccgagcagaagccacccuagggggcuucggaucgcucggccuagacugugaaccacgcaccggacuggauuucagcgaccuauacuaccuaaccaugaauaacaagcacuggcucguacacaaagaaugguuccacgacauaccacucccauggcacgccggcgccgacacagggacgccacauuggaacaacaaagaagcacucguagaauuuaaagacgcccacgccaaacgacaaacagucguggucuuggggucccaagaaggcgcgguccacacagcacucgccggcgcccuggaagcggaaauggacggcgccaagggcagacugucaucgggccaccuaaaaugccgacuaaagauggacaaacuccgccucaaaggcguaucauacucccucugcacggcagcauucacauucaccaaaauacccgcggaaacacuacacggcaccgucacaguagaaguccaauacgccggaacggacgggccguguaagguccccgcccaaauggccgucgauaugcaaacccugacuccagucggccgacuaaucacagcaaaccccgucauaacugaauccacagagaacaguaagaugaugcucgagcucgacccacccuucggcgacagcuacauaguaaucggagucggcgagaagaaaauaacacaccacuggcaccgcagcggauccaccauaggcaaagccuucgaagccaccguccgaggugccaaacgcauggcaguacugggcgacacagccugggacuucggcagcgucggaggagcccuaaacagccugggaaaaggcauacaccaaaucuucggagccgccuucaaaucccuuuucggaggcauguccugguucagccaaauccugaucggcacccugcuuauguggcuaggccuaaacaccaaaaacggauccaucagccuaaugugccuggcccuaggcggugugcuaaucuuccuaagcacugccguaucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5119 - RNA, 2284 nt, Artificial Sequence
  KU312312.1 prME-short mRNA Design 1 opt
gggagaaagcuuaccaugacuucagucggcaucguaggccuacuccucaccaccgccauggcagccgaaguaacccgccgcggcuccgcauacuacauguaccucgacaggaacgacgcuggcgaagccaucuccuuccccacaacccucggaaugaauaaaugcuacauccaaaucauggaccucgggcacacaugcgacgcaacuauguccuaugaaugccccaugcuagacgaaggcgucgaacccgaugacgucgauugcuggugcaacacaaccucaaccuggguagucuacggaaccugccaccauaagaaaggcgaagcccgcagaucccgacgcgccguaacacuaccgucccacuccacgcgcaaacuccagacaaggagccagacauggcuagaaagccgcgaauacaccaaacaccuaauaagaguagagaacuggaucuuccgaaacccaggauucgcacucgcagcagcagccaucgcauggcuacucggauccagcaccucccaaaaaguaauuuaccuggucaugauccugcuaauagcgcccgcauacagcaucaggugcauaggggucuccaauagagacuucguagaaggcaugagcggcggaacguggguagacgucguacucgaacacggcggcugcgucacuguaauggcccaagacaaaccuacgguugacaucgaacucguaacaacaaccgucucaaacauggccgaaguacgauccuacugcuacgaagccucaauauccgacauggccuccgacagccggugccccacgcaaggcgaagcauacuuagacaaacaaagcgacacacaauacgucugcaaacgaacacuggucgaccgcggcuggggaaacggcuguggacuauucggaaaaggcucacucguaacaugcgcaaaauucgccuguagcaagaaaaugacaggaaaaagcauccaacccgaaaaccucgaauaccgaaucaugcugucaguccacggaagccaacauucaggaaugaucgucaacgacacaggacacgaaacugacgaaaacagagccaaggucgagauaacaccaaacagcccacgugcagaagccacccuaggaggguucgggucacucggccuugacugcgaaccgcggacgggacuagacuucagcgaccuuuacuaccucacaaugaacaacaaacacuggcuaguucauaaagaaugguuccacgauaucccacugcccuggcacgcaggcgccgacacaggcacaccacacuggaacaacaaggaagcccucgucgaguucaaagacgcccacgcgaaaagacaaaccgucgucguacuaggcucacaagagggcgccguccacaccgcccuagccggcgcccuagaggcagaaauggacggcgcaaagggccgccucucauccgggcaccucaaaugccgccucaaaauggacaaacuccgucuuaaaggcgucucguauucccuaugcaccgccgccuucacguucaccaaaauaccggcagaaacgcuccacggaaccgucaccguagaaguacaguaugccggcacggacggccccugcaaagucccagcccaaauggccgucgacaugcagacacucaccccagucggcaggcuaaucacggcgaaucccgucaucacagaauccacagaaaacucaaaaaugaugcuagaacuagacccgccauucggcgacaguuacaucgucaucggagucggcgaaaagaagaucacacaucacuggcacagaagcggcagcacaauagggaaggccuuugaagcaaccgucagaggugccaaaagaauggcaguccucggcgacaccgccugggacuucggaucgguaggcggugcccucaacucccuaggaaagggcauccaccaaaucuucggugccgcauucaaaucccuauucgggggcaugucaugguucucacagauacuaauaggaacccuccucauguggcuaggccuaaacgccaaaaacggcagcauaagccugaugugccuagcccucggcggcguacuaaucuuccucagcacagccgucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5120 - RNA, 2272 nt, Artificial Sequence
  AY632535.2 prME-short mRNA Design 1 opt
gggagaaagcuuaccaugacgagcauaggcauaauaggacucuugcucacaaccgcaauggccgccgaaaucacgcgacgaggcucagccuacuacauguaccuagacagaagcgacgcaggcaaagccaucucguucgcaaccacacucggaguaaacaaaugccacguacaaauaauggaucucggacacaugugcgaugcaacaauguccuacgagugccccauguuagacgaaggaguagaaccggacgacgucgacugcuggugcaauaccacaagcacguggguaguauauggcacgugccaccacaagaaaggcgaagcacgcagaagccggcgcgccgucacgcuacccagccauagcaccagaaagcuccagacacggucccaaaccuggcucgagagccgcgaauauacaaaacaccugaucaaggucgaaaacuggaucuuccggaauccuggauucgcacucgucgccguugcaaucgcuuggcuccuaggcucgagcacgagccaaaaaguaaucuaccucguaaugauacuacuaaucgcgcccgcauauucuauccgaugcauaggcgugagcaaccgugacuucgucgaaggaaugucgggcgggacaugggucgauguaguacuagagcacgggggaugcgucacggucauggcacaagacaagcccaccgucgauaucgagcucgucacgaccacagugagcaacauggcugaagugcgcucauacugcuacgaagccuccauaucagacauggcauccgacagcagaugcccuacacaaggugaagcauaccuggacaaacaaucagacacacaauacgucugcaaaaggacccuagucgaucgcggaugggggaacgggugcggacuauucggcaaaggaagccuagugaccugcgcuaaauuuaccugcucgaagaaaaugacaggaaagagcauccaacccgaaaaccucgaauacagaaucaugcucucaguccacggcucucaacauagcgggaugauaggcuacgaaacugacgaggacagagccaaagucgaggucacgcccaacagcccgcgcgcagaagcuacacugggaggauucggcagccuaggacuagacugcgaaccacgcacaggacucgacuucagcgaccuauacuaccugacaaugaacaacaaacacuggcuaguccacaaagaaugguuccacgauauaccgcucccguggcacgccggcgccgacaccgguaccccacacuggaacaacaaagaagcacucgucgaguucaaagacgcacacgcaaaaagacaaacggucguaguauuaggcucgcaagaaggcgcaguccacacagcccuagcaggcgcgcuagaagcagaaauggacggcgcgaaaggcagacuauucucaggccaucucaagugccgccuaaaaauggacaaacuccgccuaaaagggguauccuacucacucugcacagcagcauucacauucaccaaaguccccgcggaaacccuacauggcacaguaaccguagaagugcaauaugccggaacggauggccccugcaagaucccgguacaaauggcgguugacaugcagacucugaccccaguagggcgccuaaucacagcaaacccuguaaucacugaauccacagaaaacucaaaaaugaugcucgaacuggacccaccauucggggacagcuacauaguaauaggagucggcgacaagaaaaucacccaccacuggcacagaagcgggaguacaaucggaaaagcguucgaggccacagucaggggcgcaaaaagaauggcaguacuaggagacaccgcuugggacuucggcagcgugggcgggguauucaacucacucggaaaaggcauccaccaaaucuucggugcagccuucaaaagccuguucggaggaauguccugguucucccaaauucucaucggaacgcuccuagucuggcucggacuaaauaccaaaaacggaucuaucagcuuaaccugccucgcgcuaggaggagugaugaucuuccuguccacagcaguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5121 - RNA, 2284 nt, Artificial Sequence
  KU527068.1 prME-short mRNA Design 1 opt
gggagaaagcuuaccaugaccuccguaggcaucguaggccuacuccugacgaccgccauggccgccgaagucacccgccgcggcuccgcauacuacauguaccucgaccgaaacgacgccggagaagccaucagcuuucccacuacccucggcaugaacaaaugcuacauccaaaucauggaccucggucacaugugcgacgcuacuaugagcuacgaaugucccaugcuagacgagggaguugaacccgacgacgucgacugcuggugcaacacaacaucaacaugggucguauacggcaccugucaccacaagaaaggcgaagcaagacguucuagacgagccguaacacuaccaucccauucgacccgcaaauuacaaacccgcucccaaaccuggcuagaaucacgagaauacaccaaacaccucauccgcgucgagaacuggaucuucaggaacccgggauucgcacuugcugccgcagcaauagcauggcuccucggauccuccaccucccaaaaaguuauauaccucgucaugauccuccuuaucgcccccgcauacucgauccgcugcauaggugucucaaaccgagacuucguggaaggcauguccgggggcacguggguagacguggucuuagaacacggcggcugcguaaccguaauggcacaagacaaaccaacaguggacaucgaacuggucaccacaacaguauccaacauggccgaaguccgcagcuauugcuacgaagcaagcauaucugauauggcguccgacucacgcugccccacucagggcgaagccuaccuugacaagcaauccgacacccaauacgucugcaaacgcacacucgucgaccgaggcuggggcaacggaugcggacuauucggaaagggcucccuagucacaugcgccaaauucgccugcuccaagaaaaugaccggcaaaucgauacaacccgaaaaccucgaauaccguauaaugcuauccguccacggcucacaacauucagggaugaucgucaacgacacaggccacgaaaccgacgaaaaccgagccaaggucgaaauaaccccgaacagccccagagccgaagccacccuaggaggcuucggcucccuaggccuagacugcgaaccccgcaccggccucgacuucuccgacuuguacuaccucacgaugaacaacaaacacuggcuaguccacaaagaaugguuccacgacauaccccucccauggcacgccggcgcagauaccggaacuccccacuggaacaacaaagaagcccuagucgaguucaaagacgcccacgccaaacgccaaacagucguaguccuaggaucccaagaaggcgccguucacacggcacucgccggagcacuagaagccgaaauggacggcgcaaaaggccgucuauccucaggccaccuuaaaugccgccugaagauggauaaacuccggcucaaaggagucuccuacucacugugcaccgccgcauucacauucaccaaaaucccagccgaaacccuccacggcacaguaaccguugaaguccaauacgccggcaccgauggcccaugcaaaguaccggcccaaauggcaguagacaugcaaacacucacacccguaggacgccucauaacggccaacccaguaauaaccgaauccacagaaaacuccaaaaugaugcuagaacuagacccacccuucggggacuccuacaucgucaucggcguaggcgaaaagaaaaucacacaucacuggcaccgcucaggaucaacaauaggaaaagccuucgaagccacaguaagaggugcaaaacgcauggcaguacuaggagacacagcaugggacuuugggucagucggcggagcccugaacucacucggaaaagggauccaccaaaucuucggcgccgcauucaaaucccuauucggaggaaugagcugguucagccaaauccucaucgggacccuacuaauguggcucggccucaacaccaaaaacggcuccaucucccuuaugugucucgcucuaggcggcguacucauauuccucagcaccgccgucucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5122 - RNA, 2284 nt, Artificial Sequence
  KX421193.1 prME-short mRNA Design 1 opt
gggagaaagcuuaccaugacgagcaucggcaucauaggucuccuccuaaccacggccauggccgccgaaaucacccgccgcggcuccgcauacuacauguaccuugaccgcucagaugccggaaaagcaaucucauucgcgacaacccucggaguaaacaaaugccacguacaaaucauggaccugggccauaugugcgacgccacgauguccuacgaaugccccaugcuagacgaaggggucgaacccgaugacguagauugcuggugcaacacaacaagcaccugggucgucuacggcacaugccaccacaagaaaggagaagcacgccgaucacgccgagccgucaccuuacccucucacucaacccgaaaacuacagacaagaucccagaccuggcuugaaagccgcgaauacacaaaacaccucaucaaagucgaaaacuggauauuccggaaccccggauucgcccuaguagcaguagcaauagcauggcugcucggauccucaacaucacaaaaaguaaucuaccucgucaugauccugcuuaucgcacccgccuacucaaucagaugcauaggagucagcaaccgcgacuucgucgaagggaugucaggaggcacgugggucgacguaguccuagaacacggcggcugcgucacaguaauggcccaagacaaaccuaccguagacaucgagcucguaaccaccacuguauccaauauggccgaaguccguucauauugcuacgaagccucaaucuccgacauggcaagcgacucccgaugccccacccaaggagaagcguaccucgacaaacaauccgacacccaguacgucugcaaacgaacuuugguagaccggggcuggggcaacggaugcggucucuucgguaaaggauccuuaguaaccugcgcaaaauuuaccugcagcaagaaaaugacaggaaaaucaauacaaccagaaaaccucgaauaccgcaucaugcucucaguccacgggucccaacacuccggaaugauagucaaugacacaggcuacgaaaccgacgaaaaccgcgccaaaguagaagucacacccaacagcccccgcgcagaggccacccucggcggcuucggcucccuaggccuagacugugaaccgcgaacaggccuggacuucuccgaccucuacuaccuuacuaugaacaacaaacacuggcucguccacaaagaaugguuccacgacaucccucuaccauggcacgccggagcagacaccggcacaccccauuggaacaacaaagaagcccuuguugaguucaaggacgcccacgcgaaacgacaaaccgugguaguacuugguucacaagaaggcgcaguccacacagcccuagccggagcccucgaagcagagauggacggagccaaaggcaaacucuucuccggccaccuaaagugcagacuaaaaauggacaaacuaagacuaaaagggguaucauacagccuaugcaccgccgcuuucaccuucacgaaagucccagccgaaacccuacacggcaccguaaccgucgaaguacaauacgcaggaaccgacggccccugcaaaauccccguccagauggccguagauaugcaaacacuaacccccgucggacgccuaauaaccgccaacccagucaucaccgaaagcacugaaaacuccaaaaugaugcuagaacucgacccgccauucggcgacagcuacaucguaaucggagucggggauaaaaagaucacccaccacuggcaccgcucaggcagcacgauaggcaaagccuucgaagccacaguccgcggggccaaacguauggcaguccuaggagacacggccugggacuucggcuccgucggcggagucuucaacucccuaggcaaaggcauccaccaaauauucggcgcggcauucaaaagccuauucggcggcauguccugguucucacaaauccuaauaggcacccuccuaguauggcuaggacuaaacaccaaaaacggauccauaagccuaaccugccuagcacuaggcggcguaaugauuuuccuaagcacggccgucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5123 - RNA, 2284 nt, Artificial Sequence
  KX377335.1 prME-short mRNA Design 1 opt
gggagaaagcuuaccaugacgaguaucgguaucauaggccuacugcugacaaccgcgauggcugcagagaucacacguagaggaagcgcauacuacauguaccuggaccgcagcgacgccggaaaagcaauaucauucgccacaacgcucggaguaaacaaaugccacguccagauaauggaccucggucacaugugcgacgcaaccaugucguacgaaugccccaugcuagacgagggagucgaaccagacgacgucgauugcuggugcaacacaaccagcacgugggucguguacggaaccugccacagaaagaaaggggaagcgagaagaagcagacgagcggucacacucccuagccacagcacacgcaaacuccaaacccgaagccaaacguggcucgaaagccgagaauacacaaaacaccucaucaaagucgaaaacuggaucuuccgcaaccccggguucgcacucguggcagucgccauagcauggcuccugggcagcagcacgagccaaaaaguaaucuaccuagugaugauacuccugaucgccccagccuacucgauacgaugcauaggcgucagcaaccgcgauuucguggaaggaauguccggcgggacguggguagacguaguccuggaacacggaggcugcgucaccguaauggcccaggacaaacccacagucgauauagagcuggugacgacaacaguaagcaacauggcagaaguacgcucguacugcuaugaagcaucgaucucggacauggcaagcgacagccgcuguccaacccaaggagaggccuaccuagacaaacagagcgacacacaguaugucugcaaaagaacccucguagacagaggcuggggaaacggaugcggccucuucggcaagggaucgcuaguaacaugcgccaaauucacaugcuccaagaaaaugacaggcaaaagcauccagcccgaaaaccuagaguaccgaauaaugcugucaguccacggcucacaacacuccggcaugauaguaaacgacaccggcuacgaaacggaugaaaacagagccaaagucgagguaaccccgaacuccccacgagcagaagcaacucucggaggguucgggagccucggguuagacugcgaaccccgcaccggauuggacuucagcgaccucuauuaccugacaaugaacaacaaacacuggcucguccacaaagagugguuucacgacaucccccuccccuggcacgcaggcgccgacacaggaacgccacacuggaacaacaaagaggccuuggucgaguucaaagacgcacacgccaaaagacaaaccguggucguacucggcagccaagaaggagcaguacacacagcgcuagcaggcgcacuagaagccgaaauggacggagcaaaagggaaauuguucucuggccaccucaaaugcagacugaaaauggacaaacuaagacugaaaggagugucauacucacugugcacagcagcauucaccuucacaaaaguaccagcggaaacccuucacgggacaguaaccguagaaguccaauacgcaggaaccgacgggccgugcaagaucccagugcagauggccgucgacaugcagacccuaaccccagucgggcgacucaucaccgccaacccaguaauaacagaaaguaccgaaaacagcaaaaugaugcuugaacuagacccacccuucggagacagcuacauaguaauaggcgugggagauaagaaaauaacccaccacuggcacagaagcgggagcacaauaggaaaagcauucgaggccaccgucaggggagcaaaaagaauggcaguacucggagacaccgccugggacuucgggucugucggaggaguauucaacucacuagggaaaggaauccaccaaauauucggcgccgccuucaagagcuuauucgggggcauguccugguucagccaaauccuaauuggaacccuccuaguguggcuaggccuaaacaccaaaaacggaagcauaagucuaacaugucuagcccuaggcggcgugaugauauuccuaagcaccgcgguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5124 - RNA, 2284 nt, Artificial Sequence
  LC002520.1 prME-short mRNA Design 1 opt
gggagaaagcuuaccaugacaagcaucggcauaaucggacuauuacucacaaccgcaauggcagccgaaauaacccgccgaggaucugccuacuacauguaccucgacaggagcgacgccggaaaagcaauaucauucgcaacaacccuagggguaaacaagugccacguacaaauaauggaccucggccacaugugcgacgccacaaugagcuacgaaugccccaugcuggacgagggcguggaaccggacgacgucgacugcuggugcaacaccacuuccaccugggucguauacggaaccugccaccacaagaaaggggaagcacgaagauccagacgagccgucacauuaccaagccacucaaccagaaaacuacagacaagaagccaaacauggcucgaaagcagggaguacacaaaacaccugauaaaagucgaaaacuggauauuccgcaaccccggguucgcccucguggccguagcaauagccuggcuacuaggcuccagcacaagccaaaaagucaucuaccuagucaugauccuccuaaucgcgccagcauacuccauccgguguauaggcgucucaaacagagacuucgucgaagggaugucaggcggaaccuggguagacgugguacucgagcacggaggcugcguaacagucauggcccaagacaaacccaccgucgacaucgaacugguaacaaccaccguaagcaacauggcugaaguccgauccuacugcuaugaagccagcaucucagacauggcaagugacucacgaugcccaacccaaggcgaagccuaccuggacaagcaaagcgacacccaguacgucugcaaacgcacccuagucgaccgaggguggggaaacggcugcggccucuucggaaaaggaucgcuagucacgugugcaaaguuuaccugcuccaagaaaaugacaggcaaaaguauacagccugaaaaccucgaguaucgaaucaugcuaucugugcacggcucacaacacucaggaaugacggucaacgacauaggauacgagaccgacgaaaaccgcgcaaaagucgaggucaccccaaacagcccacgggcagaagccacccucggaggguucggcagccuaggccucgauugcgaaccaagaacaggccuugacuucuccgaccuauacuaucucaccaugaacaacaaacacuggcugguccacaaagaaugguuccacgacauaccacuccccuggcacgcaggcgcggacacagggacgccacacuggaacaacaaagaagcccuaguagaguucaaagacgcacacgccaaacgacaaaccgucgucguucuaggcucccaagaaggcgcaguccacacggcccuagcaggagcgcuagaagccgagauggacggcgccaagggcaaacucuucagcggacaccuaaaaugcaggcuaaaaauggacaaacuacggcucaagggaguaucauacucgcugugcaccgcggcguucaccuucaccaaaguacccgccgagacccuccacggaaccguaaccgucgaaguccaauacgcagggacugacggcccgugcaaaaucccaguccaaauggcagucgacaugcaaacacuaacaccagucgggcgacucaucacagcaaaccccguaaucacagaauccaccgaaaacuccaagaugaugcucgagcuagacccgccauucggagacagcuacaucguaauaggagucggagacaaaaagaucacccaccacuggcaccgcucgggaagcacaaucggcaaggccuucgaagcaacuguaagaggcgcaaaacgcauggccguacuaggagacaccgcuugggacuucggcagcgucggcgggguguucaacucccuaggaaaaggcauacaccaaauauucggagcagcuuuuaaaucccuguucggcggcaugagcugguucagccaaauacuaauaggcacccucuuagucuggcuaggacucaacacaaagaacggcucaaucucacuaaccugccucgcacuaggaggagucaugauauuccugagcacagccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5125 - RNA, 2266 nt, Artificial Sequence
  DQ859059.1 prME-short mRNA Design 1 opt
gggagaaagcuuaccaugacaagcauaggcauagucggccugcuacucaccacugccauggccgccgaaauaacacgcagaggcuccgccuacuacauguaccucgaccgcuccgacgcaggaaaagccaucuccuucgcaaccacgcucggcgucaacaaaugucacguacaaauaauggaccuaggccacaugugcgacgccaccaugagcuacgaaugccccaugcucgacgagggcgucgagccggacgacguagacugcuggugcaacacaaccucuacauggguagucuauggaaccugccaucacaagaaaggcgaggcccgacgaagccgacgagcaguuaccuuacccagccacagcacacgcaaacuccaaacaagaagccaaacauggcuagagagccgagaauacacaaaacaccucaucaaagucgaaaacuggauauuccggaauccaggcuucacacucgucgcaguagcaauagccuggcuccucggcagcagcaccagccaaaaaguaaucuaccuagucaugauccuccuaauagcgccagccuacuccauaaggugcauaggaguaagcaaucgcgacuucguagaaggaaugagcggaggcaccugggucgacguaguccucgaacacgggggaugcguaacaguaauggcccaagacaagccaacaguagacauagagcucgucacaacgaccgucaguaacauggcagaagucaggucuuacugcuacgaagcaagcaucagcgacauggcaucagacagccgaugccccacccaaggagaagcguaccuagacaagcaaucagacacccaauacgucugcaaaaggacccuuguagauagaggauggggaaacggaugcggccucuucggcaagggcagccuaguaaccugcgcaaaauucacaugcucaaagaaaaugaccggcaaaucaauccaaccagaaaaccuugaauaccgaaucaugcucuccguccacggaagccaacacagcggaaugauagucaacgacgaaaacagagcaaaagucgaagucacucccaacucaccccgagccgaagccacccugggcggcuucggaucccugggacuugacugcgaaccucgcaccggccuagacuucagcgaccuauacuaccucacaaugaacaacaaacacuggcuaguccacaaagaaugguuucacgacauaccccucccauggcacgccggcgcagacaccggaacaccccauuggaacaacaaagaagcccuagucgaguucaaagacgcacacgcaaaacggcagacaguagucguacuaggcucccaggagggcgcaguacacaccgcacuggccggcgcccuggaagccgaaauggauggcgcaaaaggaaggcuguucucgggacaccucaaaugcaggcugaaaauggacaaacuaagacucaaagggguaucauacuccuuaugcacagccgccuucaccuucaccaaaguaccagcagagacgcuccacggcaccgugaccgucgagguacaauacgccggcaccgacggaccaugcaaaguccccgcccaaauggcaguagauaugcagacacugaccccagucggcagacuaauaaccgccaacccgguuauaaccgaaagcaccgaaaacucaaaaaugauguuggaacuggacccacccuucggcgauagcuacauagucauagguguaggagacaagaaaaucacccaccacuggcacagaucagguagcacaaucggcaaagcguucgaagccaccguccgcggcgcaaaaaggauggccguacucggcgacaccgccugggacuucggcagcgugggaggagucuucaacagccuaggaaaaggcauccaccaaaucuucggagccgccuucaaaagccucuucggaggaaugagcugguucucccaaauccucaucggaacccuacuggucuggcucggccucaacaccaaaaacggcagcaucucucuaaccugccucgcacuaggcggcgucaugauauuccucagcaccgcggucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5126 - RNA, 2272 nt, Artificial Sequence
  KU963573.2 prME-short mRNA Design 1 opt
gggagaaagcuuaccaugaccucaaucggaaucaucggacuauugcucaccaccgcgauggcagcagaaaucacacgcagaggauccgcauauuacauguaccuugaccgcagugacgccggcaaagcaaucucuuucgccacaacacucggagucaacaaaugccacguccaaaucauggaccucggccacaugugcgacgccacaauguccuacgaaugccccaugcucgacgaaggcgucgaacccgacgacgucgacugcuggugcaacaccacauccacuugggucgucuacggaaccugccaccacaagaaaggcgaggcgagacgcuccagacgcgccgucacacuacccucgcacuccacaaggaaacuccagacccgaagccagaccuggcuagagucccgggaauacaccaaacacuuaaucaaaguagagaacuggauauuuagaaaccccggauucgcucucgucgccgucgcaauugcuuggcuccuaggcucaagcaccagucaaaaaguuauuuaccuagucaugauacuacuaaucgcacccgccuacuccauccgcugcaucggagucaguaaccgcgacuucguggaaggcauguccggaggaacgugggucgacguaguccucgagcacggaggaugcgucacagucauggcacaggacaaaccaaccgucgacauagagcuagucaccacgacagucucaaacauggccgaaguaaggucuuacugcuacgaagccagcaucuccgauauggccucagacucccgaugccccacccaaggagaggccuaccucgacaaacaaucagacacccaauacguaugcaaaagaacccuaguugaccgcggcuggggaaacggcugcggccucuucggcaaagggagccuaguaaccugcgcaaaauucacaugcuccaagaaaaugaccggcaaauccauccaaccagaaaaccucgaguaccgcauaaugcucucaguacacggcucacaacacagcggaaugauaggcuacgaaaccgacgaaaaccgcgccaaagucgaagucacccccaacagcccacgcgccgaagccacacucggcggauucggcucccuaggccuagacugcgaaccccgcaccggucuugauuuuucagaccuuuauuaccucacaaugaacaacaaacacuggcucgugcauaaagaaugguuucacgauauaccacuaccguggcaugcgggagcagacaccggcacgccccacuggaacaacaaagaagcacucgucgaguucaaagacgcccaugccaaacgccaaaccguaguaguucuaggaucacaagaaggagcaguccacaccgcccucgccggagccuuagaagcagaaauggacggagcgaaaggcaaacuguucagcggccaccuaaagugcagacucaaaauggacaagcuccgccucaaaggcgucucauacucacuaugcaccgcagccuucaccuucaccaaggucccagcagaaacccuccacgggaccgucacugucgaaguccaguaugcaggcacggacggaccaugcaagaucccgguccagauggcaguagacaugcaaacccucacacccgucggccgacucaucacagcaaaccccgugaucacagaauccacugaaaacucaaaaaugaugcucgaacucgacccgcccuucggcgacagcuacaucgucaucggcgucggcgacaaaaagauaacccaccacuggcaccgcagcgggucaacuaucggcaaagcauucgaagccaccguccgcggcgccaaacgaauggccguacucggagacacggccugggauuucggcuccguaggcggaguauucaacagccuaggaaagggcauccaccaaaucuucggagcagcauucaaaagccuauucggcggcaugucaugguuuucccaaauacugaucggcacacucuuagucuggcucggacucaacaccaagaacggcuccaucagccuaaccugccucgcacuaggcggagucaugaucuuccuaagcaccgccguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5127 - RNA, 2284 nt, Artificial Sequence
  KX694534.2 prME-short mRNA Design 1 opt
gggagaaagcuuaccaugaccuccgucggaauagucggccucuuacuaaccacugccauggccgcagaaguaacccgccgagggagcgcauacuacauguaccucgaccgcaacgacgcaggagaagccaucagcuuccccacgacgcuaggcaugaacaagugcuacauacagaucauggaccuaggccauaugugcgacgccacaaugucauacgaaugcccaaugcuagacgaaggcgucgaacccgacgacgucgacugcuggugcaauacaacaagcacuuggguagucuacggaaccugccaccacaagaaaggggaagcacgacgaagccgccgagcagucacucuccccucacacagcacccggaaacuccaaacacgcagccaaaccuggcuagaaagccgagaauauacaaaacaccucauacgaguagaaaacuggaucuuccgaaacccaggcuucgcauuagccgccgcggccaucgccuggcuacugggcucgucaacaucacagaaaguuaucuaccuaguaaugauacuucuaaucgcccccgccuacagcauaagaugcaucggcguaagcaacagagacuucguagaggggaugagcggcgggaccuggguagacgucguccuggagcacggcgguugcgucacgguaauggcccaagacaaaccaaccguugacaucgaacucguaacgacgaccguguccaacauggcagaaguccgaucauacugcuacgaagccagcaucagcgacauggcauccgacucuagaugcccgacccagggagaagccuaccuugacaaacaaagugacacacaauacgucugcaaacgaacccucgucgaccgcggcuggggcaacggcugcggccucuucgggaaaggcagccuaguaaccugugcgaaauucgcaugcagcaagaaaaugacagggaaauccauacagccagaaaaccuagaauaccgcauaaugcugaguguccacggaucucaacacagcggcaugaucguaaacgacacaggacacgaaacagacgaaaaccgagcaaaaguagagaucaccccgaacagcccccgagcggaagcaacacuaggcggauucggcagccugggccucgacugugaacccagaacaggcuuagacuucagcgaccucuacuaccucaccaugaacaacaaacacuggcucguccauaaagaaugguuccacgacaucccgcucccauggcacgccggcgcagacacaggaacgccacacuggaacaacaaagaggcgcuaguggaguucaaagacgcacacgccaaacgccagaccguagucguacuaggaucacaagaaggcgccguucacacagcccuagccggagcacucgaagccgaaauggacggcgcaaagggcagacuaucaucaggccaccuaaaaugccgccuaaagauggacaaacugcgccuaaaaggcgugucauacucacuaugcacagcagcauucacguuuaccaagauaccagcagaaacacuacacgguacagucaccgucgaaguccaauacgcagggaccgacggaccaugcaaaguacccgcccaaauggcaguggacaugcaaacacucacaccgguaggacgacuuaucaccgccaacccgguaauaacagaauccaccgaaaacagcaaaaugaugcucgaacucgacccacccuucggagacuccuacauaguaauaggcgucggagaaaagaaaaucacacaccacuggcaccgcuccggcuccaccaucgggaaagcauucgaagccacagucagaggagccaaacgaauggcgguccugggcgacacggcaugggacuucggaagcgucgggggcgcacucaacucacucggccguggaauacaccaaaucuucggggccgcguucaaaagccucuucggcggcaugagcugguucucgcaaauccucauaggcacccuacucauguggcucggacuaaacaccaaaaacggaucaaucagccucaugugcuuagcccuaggcggcguccucauuuuucucagcaccgcgguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5128 - RNA, 2284 nt, Artificial Sequence
  KX369547.1 prME-short mRNA Design 1 opt
gggagaaagcuuaccaugaccuccguaggaaucguuggcuuacuccucaccaccgcaauggcagcagaaguaacucggcgcggcucagccuacuacauguaccucgaccgcaacgacgcaggagaagccauaagcuuccccaccacccuuggcaugaacaaaugcuacauccaaauaauggaccuuggucacaugugcgacgcgaccaugagcuacgaaugccccaugcuagacgaaggagucgaaccagacgacguagacugcuggugcaacaccacaagcaccugggucguauacggcaccugccaccacaaaaaaggcgaagccagacgcucacgacgagccgucacucuucccucccacuccacccgcaaacuacaaacgcgaucccaaaccugguuagaaagccgcgaauacaccaaacaccuuauaagggucgagaacuggauauuccgcaaucccggacuagcucuugcagccgcagcaauagccuggcuacuaggaucguccaccucacaaaaagucauauaccuagucaugauccuccuaauagcuccagccuacagcauacguugcaucggcguuuccaaccgggacuucguagaaggcaugagcggcggcaccugggucgacguuguacuggaacacggaggaugcgucaccgucauggcccaagacaaacccacugucgacaucgaacuaguaaccacaaccgucagcaacauggccgagguacgcagcuacugcuacgaggcguccaucagcgacauggcguccgacucacggugccccacccaaggcgaagcauaccuagacaaacaaucugacacccaauacguaugcaaacgaacccucguggaccgaggauggggcaacggcugcggccuguucggcaaaggcucacuagucaccugugcaaaauucgccugcuccaaaaaaaugacagggaaauccauacaacccgaaaaccuagaauauagaaucaugcuaagcgugcacgguucccagcauuccggcaugauaguaaacgacaccggccacgaaaccgacgaaaaccgugcaaaagucgaaauaacuccaaacucaccccgcgccgaagcaaccuuaggcggcuucggcucacucggccuagacugcgagccccgcaccggguuagacuucuccgaccuguacuaccuuaccaugaacaacaaacacuggcuaguacacaaagaaugguuccacgacauaccccuaccauggcacgcgggggccgacacaggaaccccccacuggaacaauaaagaagcccucgucgaauucaaagacgcccacgcuaagcgccaaaccguagucguccuagggucacaggagggagccguccacacugcccuagccggcgcucucgaagcagaaauggauggcgcaaaagggcgacuuagcuccggacaccuaaaaugucgccucaaaauggacaaauugcgacuuaaaggagucucuuacucucucugcaccgccgccuucacauucacaaaaaucccagccgaaacccuccacggcaccgucaccguagaaguccaauaugcaggcaccgacggacccugcaaagucccugcacaaauggccgucgacaugcaaacacucacaccaguaggccgacucauaacugccaacccgguaaucaccgaauccacugaaaacucgaaaaugaugcucgaacucgacccaccauucggagacucauacauagucauaggugucggagaaaaaaaaauaacccaucacuggcacagaucaggcucaaccaucggcaaggcauucgaagccaccguaaggggcgcaaaacgcauggccguccuaggagacaccgcaugggacuucggaucgguaggcggcgcacucaacagccuaggcaaaggcauacaccagauauucggcgcagccuuuaaaagccucuucggcggaaugucaugguucagccagauccucauaggcacacuccuuauguggcuaggccuaaacacaaaaaacggauccaucucccucaugugccucgcccucggaggaguacugaucuuccuaucgaccgcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5129 - RNA, 2284 nt, Artificial Sequence
  KX447515.1 prME-short mRNA Design 1 opt
gggagaaagcuuaccaugacaagcguagguauagucggccuccuccucaccaccgcaauggcagccgaggucacacgcagaggcagcgcauacuacauguaccuagaccggaacgacgcaggagaagcaaucucguucccaaccacccuugggaugaacaaaugcuacauacagauaauggaccugggacauaugugcgacgccacaauguccuacgaaugcccaaugcucgacgaggggguagaacccgaugacguagacugcuggugcaacaccacaagcacaugggucgucuacggcacaugccaccacaagaaaggggaagcccggaggagcagacgagcagucacacuccccagccacagcacaagaaaacuacagacccgcucacaaaccuggcuagaaagccgagaguacacaaaacaccucauacgaguugaaaacuggaucuuccgcaaccccggauucgcgcuagccgcggcagcaauagcauggcuccugggaucuagcaccagucaaaaaguuaucuaccuugucaugauacuccuaauagcccccgcauacagcauacgaugcauaggcguaagcaaccgcgacuucgucgaagggaugucaggagggaccugggucgacguaguacuagaacacggcggaugcgugacagucauggcccaagacaaacccacaguagacauagagcucgucacaaccacaguauccaacauggccgaaguccgcucguacugcuacgaagcaucaaucagcgacauggccucagacucccgcugccccacgcagggagaagcauaccucgacaaacaaucagacacacaguacgucugcaaaaggacccuaguagaccgaggaugggggaacgggugcggacucuuuggaaagggaucgcucguaacaugcgcaaaauucgccugcagcaaaaagaugacaggcaaaucaauacagccggaaaaccucgaauaccggaucaugcucuccguacacggcucacaacacucgggcaugauagucaacgacacaggccacgaaacagacgaaaacagggccaaagucgaaaucaccccgaacucaccgcgcgcagaggcuacccuaggaggguucggaucccucggccuagacugcgaaccgcgaacaggacuggacuucagugaccucuacuaccuaaccaugaacaacaaacacuggcuaguccacaaagaaugguuccacgacauaccccuccccuggcacgcaggagccgauaccggcacgccgcacuggaacaacaaagaggcccuagucgaguucaaagacgcacacgcaaaaaggcaaacggucgucguacucggcucgcaagaaggagcaguacauacagcacuagcaggcgcacucgaggccgaaauggacggagccaaagggcgccuuuccagcggccaccucaaaugccggcuuaaaauggacaaacuuaggcuaaaaggggucuccuacagccucugcaccgccgccuucacauucacuaaaaucccagcagagacccuacacggaacagugaccguagaagugcaauacgccgggacagacggacccugcaaaguacccgcacaaauggccguugacaugcagacacuaacccccgucggacgacuaaucaccgccaauccggugauaaccgaaucgacugaaaacagcaaaaugaugcucgaacucgacccacccuucggcgacagcuacaucguaauaggagucggcgaaaagaaaauaacccaccacugguaccgcuccggaagcaccaucggcaaagcguucgaagccacggucagaggugcaaaacgcauggccguccuaggcgauacggccugggacuucggaagcguugggggagcacuaaacucacuaggcaaagggauacaccaaauauucggugccgcauucaaaucccuguucggaggaaugucaugguucucacaaauacuaauaggcacacuacuaauguggcugggccucaacaccaagaacggaagcauuucccuaaugugccucgcccucggcggcguacuaaucuuccuauccacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5130 - RNA, 2284 nt, Artificial Sequence
  KU729218.1 prME-short mRNA Design 1 opt
gggagaaagcuuaccaugacgucuguaggcauaguuggccuacuccucacaacagccauggcagccgaaguaacccgccgcggcucagccuauuacauguaccuggaccgaaacgacgcuggagaagccaucucauuccccaccacccucggaaugaacaaaugcuacauacaaaucauggaccucggacacaugugcgacgcgaccaugaguuacgaaugcccaauguuggacgaaggagucgagcccgacgacguugacugcugguguaacaccaccaguacuugggucgucuacggaaccugccaccacaagaaaggggaagcccgacgaucccgccgggcgguaacccuaccuucccacagcacccgcaaacuccaaacacgaucacaaaccuggcucgaaagcagagaauacacgaaacaucucauacgaguagagaacuggauauucagaaauccgggauucgcacuagccgccgccgccaucgccuggcuccugggaucaucaaccagccaaaaaguaauauaccucgugaugauccuccuaauagcccccgcguacucaauacgcugcauaggcgucagcaaccgggacuucguagaaggcauguccgggggcaccugggucgacguaguacucgagcacggcggcugcgugaccguaauggcccaagacaaacccaccguagacaucgaacugguuacaaccacagugucaaacauggcagaagucagaagcuacugcuacgaagccucgauaagcgacauggccuccgacagccgaugccccacccaaggagaagccuaccuagacaaacaaucagacacacaauacgucugcaaacgaacccuaguagaccgcggcuggggcaacggaugcggccuuuucggaaaaggcucacuuguaaccugcgccaaauucgcaugcagcaagaaaaugaccggaaaaucaauccaaccagaaaaccuagaguaucgcaucaugcucuccguacacggaucacaacacucaggcaugauagucaaugauacgggccacgaaaccgacgaaaauagagcaaaagucgagaucacccccaacagcccccgcgccgaagcaacacucggaggauucgggagccucggacucgacugcgaaccccgaacaggccuagacuucucagaccuauacuaccucaccaugaacaacaaacacuggcucguacacaaagaaugguuucacgacauaccacuacccuggcacgcuggggccgacaccgggacuccccacuggaauaacaaagaagcccuaguagaguucaaagacgcccacgccaaacgccaaacggucguaguacucggcagccaagaaggggccguccacaccgcgcucgccggagcccucgaagccgaaauggacggagcaaagggacggcuauccucagggcaccucaaaugcagacuaaagauggacaaacuccgucugaagggcguuuccuauagccucugcaccgcagcauucaccuucacaaagaucccggccgaaacacuccacgggaccgucaccguagaagugcaauacgccggcacagauggccccugcaaaguccccgcccagauggccgucgacacccaaacgcugacacccgucggccgccuaaucaccgcgaaucccgucauaacugaauccaccgaaaacucgaaaaugauguuagaacucgaucccccauucggggacucauacaucguaauaggcgucggagaaaagaaaauaacccaccacuggcaccgaucaggcagcaccauaggcaaagccuucgaagccacuguaaggggcgcaaaacgcauggcaguacuaggagacaccgcaugggacuuuggcucagucggcggagcccucaacucccuaggcaaaggaauacaccagauuuucggagcagcuuucaaaagccucuucggcggcaugagcugguucucccagauucuaauaggcacccugcucauguggcucggacugaacaccaaaaacggauccaucucccucaugugccuagcacugggcggcguccuaauauuccugucuaccgccguauccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5131 - RNA, 2284 nt, Artificial Sequence
  KU501217.1 prME-short mRNA Design 1 opt
gggagaaagcuuaccaugacauccgugggcauagucggucuccuacuuaccacagcaauggcagccgaaguaacacgccgaggcucagcauacuacauguaccucgaccggaacgacgcaggcgaagcaauauccuucccaaccacacucggcaugaacaaaugcuacauccaaaucauggaccucggccacaugugcgacgccacaauguccuacgaaugccccaugcucgacgaagggguggaaccagacgacgucgacuguuggugcaacaccaccuccaccugggucgucuacgggaccugccaccacaagaaaggcgaagcccgccgaagcagacgcgcagucacacucccuucccacucaacccgcaaacugcaaacccgcucacaaaccuggcucgaaagccgcgaauacaccaaacaccuuauaagaguagaaaacuggaucuuccgaaacccaggcuucgcacucgccgcagccgccauagccuggcuacuugggagcuccacgucccaaaaaguaauauaccucguaaugauucuccuaauagcgccagccuacuccauccggugcauaggagucucaaacagagacuucgucgaagguaugucgggaggaaccugggucgacguaguacuagaacacgggggcugcgucacugucauggcacaagacaaaccgaccgucgacauagaacucguaacaaccaccgugucuaacauggccgaaauccgaagcuacugcuacgaagcaagcauaagcgacauggccuccgacucgcgaugcccaacccaaggagaagccuaccuugacaaacaaagugauacacaauacgucugcaagagaacauuaguagaccgaggaugggggaacggaugcggccuauucggcaaaggcucacucgucacgugcgccaaguucgcuugcuccaagaaaaugaccggcaaaagcauacaaccugaaaaccucgaauacagaauaaugcuauccguccacggcucccaacacagcggaaugaucgucaacgacacaggacacgaaacagacgaaaaccgcgccaaaguagaaaucacccccaacucaccccgagcagaagccacucucggcggcuucggcucccuaggacuagacugcgaaccccgaaccggccuggacuuuuccgaccucuacuaccugaccaugaauaacaaacacuggcuaguacacaaagaaugguuccacgacauacccuuacccuggcacgccggcgccgacaccggcacaccccacuggaacaacaaagaagcccuggucgaguucaaggacgcacacgcaaaacgucaaaccguaguaguccucggcucccaagaaggcgccguccacaccgcccuagcaggggcacuagaagcagaaauggacggggccaaaggaagacuauccagcggccaccucaaaugccgacucaaaauggacaaacucagacucaaaggaguaucauacagccuauguaccgcagcguucaccuucaccaaaaucccagccgaaacacuacacgggacaguaaccguagaaguacaauacgccggaacugacggacccugcaaaguacccgcacaaauggcuguggacaugcaaaccuuaaccccagugggcagacugaucacagccaaccccguaauaacggaaucgacggaaaacuccaaaaugaugcucgaacuagacccucccuucggcgacucauacaucgucaucggcgucggcgagaaaaagaucacccaccauuggcaccgaagcggcagcacgauaggcaaagcauucgaagcaacaguaagaggcgccaaacgaauggccguccuaggagacaccgcaugggacuucggcagcguaggaggcgcacuaaacucacucggaaaaggaauccaccaaaucuucggagcagccuucaaaucccuauucgggggcaugaguugguucucccaaauacucaucggcacccuacuuauguggcucggccuuaacaccaagaacggaagcauaagccugaugugccucgcccugggcggcguccucaucuuccuuucuaccgcaguaucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5132 - RNA, 2284 nt, Artificial Sequence
  KU312314.1 prME-short mRNA Design 1 opt
gggagaaagcuuaccaugaccagcgugggaaucgucggacuacuccuaacaaccgcgauggcugccgaaguaacccgacgcgggagcgccuacuacauguacuuagacagaaacgacgcaggggaagcaaucagcuucccuacaacgcucggaaugaacaaaugcuacauacaaauaauggaccucggacacaugugcgacgcaacaaugaguuacgaaugcccaaugcuagacgaaggcguagaaccagacgacguagacugcuggugcaacaccacgagcacguggguagucuacgguacgugucaccacaagaaaggcgaagcacgacgcuccaggagagccguaacgcucccgagccacucgacacgaaaacuccaaacacgcagccaaaccuggcuagaaucacgagaauacacgaagcaccuaauccgaguagaaaacuggauauuccgaaaccccggauucgcgcucgccgccgcggccaucgcauggcuccuugggagcagcacaagccaaaaagugauauaccuaguaaugauccuacucaucgccccagcauacaguauacgaugcaucggagugagcaaccgcgacuucguggaaggaauguccgggggcaccugggucgacgucguccuggaacacggcggaugcgucacggucauggcacaagacaaaccaacaguggacauagaacucgucaccaccacagucagcaacauggcagaaguccgcagcuacugcuacgaagccagcaucucagacauggccuccgacagcagaugccccacccaaggcgaagcguaccuagacaaacaguccgacacgcaauacgucugcaaacggacacucguagacagaggauggggaaacggcugcggccuguucggcaaaggcucccuagucaccugugcaaaguucgccugcagcaagaaaaugacaggcaaaucaauccagccggaaaaccucgaauacagaauaaugcucagcguccacggcucccaacauagcggcaugauaguaaacgacacgggccacgaaacagacgaaaaccgagccaaagucgaaauaacacccaacagcccccgcgcggaagccacacucggaggcuucgggucgcuaggacucgacugugaaccaagaacaggccuggacuucagcgaccucuacuaccucaccaugaacaacaaacacuggcuugugcauaaagaaugguuccacgacauaccacucccguggcaugccggagcagacaccggaacaccacacuggaacaacaaagaagcccuaguggaguucaaagacgcacacgcaaaacgacaaacaguagucguacuaggaucccaagaaggcgcuguacacaccgcacuagccggcgcacuagaagccgaaauggacggagcaaaaggacgccuauccucaggccaccucaagugcaggcuaaagauggacaaacuccgauuaaagggagucuccuacagccugugcaccgccgccuucaccuucaccaaaaucccagccgaaacacugcacgggaccgugacaguagaaguacaauacgccggcacagauggacccugcaaaguacuagcacaaauggccgucgacaugcaaacacuaaccccagucggccgccucauaacggcaaaccccgugaucacagaauccacagaaaacucgaaaaugaugcuagaacucgacccacccuucggcgacucauacauaguaaucggaguaggagaaaagaaaauaacccaccacuggcacagaagcggaagcacaauaggcaaagccuucgaagcaaccguccgaggagccaaaagaauggcagucuuaggcgacaccgcaugggacuucgggagcgugggcggagcacuaaacagcuugggaaaaggaauccaccaaauauucggagcagcguucaaaagccuguucggaggcaugaguugguucagucagauccucaucggcacacuccucauguggcuaggacuaaacaccaaaaacggcagcaucucacugaugugccucgcgcucggaggcguacugauauuccugagcaccgccguauccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5133 - RNA, 2284 nt, Artificial Sequence
  KX446950.2 prME-short mRNA Design 1 opt
gggagaaagcuuaccaugaccucagucgggauugucggacuccuacucaccacagccauggcagccgaggugacccgacgaggaucagccuacuacauguaucucgaucgcaacgacgcaggcgaagccauaucguuccccacaacccucggcaugaacaaaugcuacauccaaaucauggacuuaggccauaugugcgacgccaccaugucauacgaaugccccacacuagacgaaggcgucgaacccgacgacgucgacugcuggugcaauaccaccuccacaugggucguauacggcacaugccaccacaagaaaggcgaagcccgccgaucccgcagagccguuaccuuaccaagccacuccacccgaaaacuccaaacgcggagccaaaccuggcuagaaagccgcgaauacacaaaacaccucauccgcgucgaaaacuggauauuccgcaacccaggauucgcccucgccgccgccgcaauagcauggcugcucggcuccagcacaucccaaaaagucaucuaccucguaaugauccuucucaucgcccccgccuacuccauccgcugcaucggcgucucaaaccgagacuucgucgaaggcaugucaggcggcaccugggucgacgucguccuggaacacggaggcugcguaaccgucauggcccaagacaaaccgacaguagacaucgagcuagugaccacaacagucagcaauauggccgaagucagaucuuacugcuaugaagcguccaucucugacauggccuccgacucacgcugucccacgcaaggggaagccuaccuggacaaacaaagcgacacgcaguacgucuguaaacgcacccuagucgaccgcggcuggggcaacggaugcggacuauuuggaaaaggcucacucgucacuugcgccaaauucgccugcucaaagaagaugaccggaaagucuauccaaccggaaaaccuagaauaccgcauaaugcuauccguccacgggucacaacacucaggaaugauagucaaugacaccggacacgaaaccgacgaaaaccgugcuaaaguagaaaucacccccaacuccccuagagccgaagcaacccuagggggauucggaagucuaggccuggacugcgaaccacgcaccggccuggacuucuccgaccucuacuaccucacaaugaacaacaagcacuggcuaguccacaaagaaugguuccacgacaucccacuaccuuggcacgccggcgccgacacaggcacaccccacuggaacaacaaagaagcccucguagaguucaaagacgcucacgccaaacgucaaaccgucgucguccuagggagccaagaaggcgcaguccacaccgcguuggcaggcgcccuagaagcagaaauggacggagcaaaaggacgacucuccucgggccaccuaaaaugccggcuaaaaauggacaaacuacgccucaaaggcgucuccuacagccucugcaccgcagccuucaccuucaccaagaucccagccgaaacccuucacggcaccguaaccguagaaguccaauacgcaggcacagacggcccaugcaaaguaccagcccaaauggcaguagauaugcaaacacuaaccccuguuggccgccucaucacagccaaccccguaaucaccgaaagcaccgagaacucaaaaaugaugcuagagcucgacccacccuuuggcgauuccuacaucgucaucgggguaggcgaaaagaaaaucacgcaccacuggcacagguccggaagcacaaucggcaaagcguucgaggcaacuguccgaggcgccaaacgaauggcaguccucggugacaccgccugggauuucggaagcgucggcggugcccucaauagccuaggcaagggcauccaccaaaucuucggcgccgccuucaaaucccuguucggaggcaugucaugguucucacagauccuaauaggcacccugcuaauguggcuaggccucaacaccaaaaacggaucgaucuccuuaaugugccuagcacucggcgggguccuaaucuuccuauccacagccguaucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5134 - RNA, 2284 nt, Artificial Sequence
  KY003157.1 prME-short mRNA Design 1 opt
gggagaaagcuuaccaugaccucgguagggaucgucggccuacuccuaacaacagccauggccgccgaagucacccgccgaggaagugccuacuacauguacuuagaccgaaacgacgccggggaggccauaucguuccccacaacacuaggaaugaacaaaugcuacauucagauaauggaccuaggacacaugugugacgcaaccaugaguuacgaaugucccaugcuggacgaaggaguagagcccgacgacguagacugcuggugcaacacaaccagcacuuggguagucuacggaacgugucaucacaagaaaggcgaagcacgacgaucccgaagggcuguaacgcugccaucacacucgacccgaaaacuucaaacacgaucgcaaacauggcuagagucccgcgaauacacaaaacaccucauacgcgucgaaaacuggauauuccgcaaccccggcuucgcccuggccgcagccgccaucgcauggcuccucggcagcaguaccucccaaaaagucaucuaccucguaaugauccuacuaaucgccccagcauacagcauacgaugcaucggaguaucaaaccgcgacuucgucgaaggcaugagcggcggaacauggguagacguaguauuagaacacggaggcugcguaacuguaauggcgcaagacaaaccgacaguagacaucgagcuagucaccaccaccgucaguaacauggcagaaguccggucauacugcuacgaagccagcauaucagacauggcguccgacagccggugccccacccagggcgaagccuaccuagacaaacaauccgacacccaauacgugugcaaaagaacccuaguagacagaggauggggcaacggaugcggccuauucgggaaagggucgcucguaacaugcgcaaaauucgccugcucaaagaaaaugacagggaaaucaauccaaccagaaaaccuagaauacagaaucaugcuaucuguccacggcucccagcacagcggcaugauagucaacgacacaggccacgaaaccgacgaaaacagggccaaaguagaaaucacaccaaacuccccacgcgccgaagcaacauuaggcggcuucggcagccuaggccucgacugcgagccccgaacgggccuugacuucuccgaccuauacuaccucaccaugaacaacaaacacuggcuuguacacaaagagugguuccacgacauaccccuacccuggcacgcaggcgccgacacaggcacaccccacuggaacaacaaagaagcccuggucgaguucaaagacgcacacgcaaaacgccaaacaguaguuguacucggaagccaggaaggcgcuguacacacagcccucgcaggagcucuggaagccgaaauggacggugcaaaaggccgacucucaagcggccaccugaaaugcagacuaaaaauggacaaacucagacucaaaggggugagcuacagccucugcacagccgcauucacauucacaaaaauaccagccgaaacccuucacgguacagucacaguggagguccaauacgcaggaacggacggaccaugcaaagugcccgcccaaauggcagucgacaugcaaacccucacgcccguagggaggcucauaacagcuaaccccguaauaacagagagcacggaaaacagcaaaaugaugcucgagcucgacccgcccuuuggggacagcuacauagucaucggcguaggagaaaagaaaaucacacaucacuggcaccgaagcggcucaacaauaggcaaagcguucgaagcaacaguacgaggcgccaaaagaauggcugugcucggagacaccgccugggacuucgguuccguaggcggagcacucaacucucugggcaaaggcauacaccaaaucuucggagcagccuucaaaucccucuucggaggaaugucaugguucagccaaauccucauaggaacacugcucauguggcucggacuaaacaccaaaaacggcagcauaucccuaaugugccuggcacuaggaggcguccuaauauuccucucuaccgugguaucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5135 - RNA, 2284 nt, Artificial Sequence
  KX811222.1 prME-short mRNA Design 1 opt
gggagaaagcuuaccaugaccagcguaggcaucgucgggcuacuacuaacaaccgcgauggccgccgaagucacacgcagaggguccgccuauuacauguaccuagacaggaacgacgccggcgaagcaauaucauucccgaccacgcuggggaugaacaaaugcuacauacagauaauggaccucgggcacaugugcgacgcaacaaugaguuacgaaugccccaugcuggacgaaggcguagaaccggacgacgucgacugcuggugcaacacaacgagugcauggguggucuacggaaccugccaccacaagaaaggcgaagcgcgcagaagccgccgagcagucacacuaccaagccacaguacacguaagcuccaaacaagaccacaaacauggcucgagucccgagaguacacaaaacacuuaauacgaguagagaacuggaucuucagaaacccaggauucgcacucgcagccgcagcaaucgcauggcuacuggguuccagcaccagccaaaaagucaucuaccucguaaugauacuccuaaucgccccggccuacuccaucaggugcaucggaguaagcaaccgcgauuucgucgaagggaugucgggaggaaccuggguagacgucguacucgaacacggcggcugugucacgguaauggcccaagacaaaccaacuguagacaucgagcuaguaaccacgaccguaucaaacauggccgaagucagaagcuacugcuacgaagcaucaaucagcgacauggccuccgacagcagaugccccacccaaggcgaagccuaccuggacaaacaaagcgacacacaauacguaugcaagagaacacuggucgaccgaggauggggcaacggcugcggccucuucgguaaagggucgcuaguuacaugcgccaaauucgcgugcagcaagaaaaugaccggaaaaagcauccaaccagaaaaccucgaauacagaaucaugcuauccguacacggcagccagcacagcggcaugauaguaaacgacaccgggcacgaaacagacgaaaacagggcaaaagucgagauaacacccaacucuccacgagccgaagcaacccucggaggauucgggagccucggacuagacugugaaccgaggaccggccuagacuucagcgaccuguacuacuuaacaaugaauaacaaacacuggcuuguacacaaagagugguuccacgacaucccccuaccauggcacgccggcgcagacaccggaacgccgcacuggaacaauaaagaggcccuaguagaguucaaagacgcccacgcaaaacgacaaacuguagucguccuaggcucacaagagggagcaguccauaccgcccuagccggagcgcucgaagcagagauggacggagcgaaagggcgccuaucaagcggacaccuaaagugcaggcuaaaaauggauaaacugcgccucaagggcgucagcuacucacucugcacagcagcauucacauucacaaaaaucccggccgaaacccuacacggaaccguaacaguagaaguacaguacgcaggaaccgacggacccugcaaagucccggcccaaauggcgguugacaugcaaacccuaacgcccguaggacgccugaucacagccaaccccguaaucacagaaucaaccgaaaauucaaagaugaugcuggaacuggacccgccauucggagacagcuacaucguaauaggggucggcgaaaagaaaauaacacaccacuggcaccgauccggaagcaccauuggaaaagcauucgaggccacagucaggggagcgaaacgaauggcaguccucggggauacagcaugggacuucggauccguaggcggagcccugaacucacugggcaaaggaauccaccaaauauucggagcagcguucaaaucacuauucggaggcaugagcugguucucacaaauacuaauaggcacacuacuaauguggcucggccuaaacacgaaaaacggcagcaucucccuaaugugccuggcccuaggaggcguacuaauauuccuaucaacagccguuuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5136 - RNA, 2284 nt, Artificial Sequence
  KX447516.1 prME-short mRNA Design 1 opt
gggagaaagcuuaccaugacaucagucggaaucgucggccucuugcuuacaacagccauggccgcggagguaacacgccggggcagcgccuacuacauguaccuagacagaaacgacgccggcgaagcaaucagcuuccccaccacacucgguaugaacaaaugcuacauccaaaucauggaccucggccacaugugcgacgccaccauguccuacgaaugccccaugcuagacgaaggcgucgaacccgacgacguagacugcuggugcaacaccaccagcacauggguggucuacggaaccugccaccacaagaaaggagaagcccgaaggagccgccgcgcagucacccuacccagccacucaacaagaaaacugcagacacgaagccaaacauggcuagaaucccgcgaauacacaaaacaccuaaucagagucgaaaacuggaucuucagaaauccaggcuucgcacucgccgcugcagcaauagcguggcuacucggcagcucaacaucaaagaaaguaaucuaccuaguaaugauccuacugauagcaccagccuacagcaucagaugcaucgggguauccaacagagacuucgucgaaggcaugagcggagggacguggguagacgucguccucgaacacggcggaugcgucaccguaauggcacaagacaaaccaacagucgacauagaacucguaaccacaaccgucucgaacauggccgaaguccgaagcuacugcuacgaagcgagcaucagcgacauggcaucagacucacggugcccaacccaaggagaagcauaccuagacaaacagagcgacacccaauacgucuguaaaagaacccucgucgaccgcggauggggcaacggcugcggccuauucggaaaaggaucacucguaaccugcgccaaauucgccugcuccaagaaaaugacaggaaaaaguauucagcccgaaaaccuugaguaccgcaucaugcugucgguccacggaagucaacacagcggcaugaucguaaacgacacuggacacgagaccgacgaaaaucgagcaaaagucgaaauaacaccgaacucaccccgcgccgaagccacccuuggcggauucggaucccucggccuagacugcgaacccagaaccggccuagacuucucggaccucuauuaucucacgaugaacaacaaacacuggcuuguccacaaagaaugguuccacgacauuccacuacccuggcacgcaggagcagacaccggcaccccacacuggaacaacaaagaagcccuaguggaguucaaagacgcccacgccaaacgccagacaguaguaguccuaggcucccaagaaggagccguccacacagcccuggccggcgcacuagaagccgaaauggacggggcgaaagggcgccuuaguagcgggcaucuuaaaugccgccuaaaaauggacaaacucagacucaaaggagucagcuauucccucugcacugcagcauucaccuucacuaaaaucccagccgaaacccuacacggcaccguaaccguggaaguacaauacgcgggcacagacggcccaugcaaaguacccgcccaaauggccguagacaugcaaacccucacaccagugggcaggcucauaacagccaaccccgucaucacggaaucgaccgagaacaguaaaaugaugcuggaauuagacccgcccuucggagauagcuacaucguaaucggaguaggagagaagaaaaucacacaccacuggcaccgaucaggcagcacaaucggcaaggcuuucgaggccaccguaagaggcgcgaaacgcauggcaguacuaggcgacacagccugggacuucggcucaguuggaggcgcccuaaacagccuaggcaaaggcauccaccaaaucuucggcgccgcauuuaaaagccuauucggcggaauguccugguucagccagauccugaucggaacucuccuaauguggcugggguuaaacaccaaaaacgggucgaucucacuaaugugccucgcacuaggcggaguacuaaucuuccugagcacagcagucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5137 - RNA, 2284 nt, Artificial Sequence
  KX520666.1 prME-short mRNA Design 1 opt
gggagaaagcuuaccaugacauccgucgggaucgucggccuccuacugacaaccgcuauggccgccgaagucacacgcagaggauccgcuuauuacauguaccucgaccgaaacgacgcaggcgaagcgaucaguuuccccacaacccucggaaugaacaaaugcuacauacaaaucauggaccucggacacaugugcgaugcgacgauguccuacgaaugccccauguuagacgaaggcgucgaacccgacgauguagacugcuggugcaacacaaccagcaccuggguaguauacggcacaugccaccacaagaaaggagaggcccgcagaucacgcagagcagucacacuacccagucacagcacgagaaaacuccaaacaaggagccagacauggcucgagagccgggaauacacaaaacaccuaauacgaguagaaaacuggaucuuccgaaacccaggauucgcgcucgccgccgccgccaucgccuggcuccucggcagcagcaccagacagaaaguaauauaccucgucaugauccuccuaauagcaccagcauauucaauacgaugcaucgggguaagcaaccgcgacuucguugaagggauguccggcggaacauggguagaugucguccuugaacacggcggcugcguaaccguaauggcccaagacaaacccacgguagacauagagcucguuacaacaaccguauccaacauggccgaagucaggagcuacugcuacgaggccagcauauccgacauggccagcgacagcagaugucccacacaaggagaagcguaccucgacaaacaaagcgacacacaauacguaugcaaacgaacccuagucgacagaggcuggggaaacggaugcggccucuucggcaagggcucccucguaaccugugcaaaguucgccugcuccaagaagaugaccggcaaaagcauacaacccgaaaaccuagaauaucgaaucaugcuaagcguacacgggagccaacacucaggcaugaucgucaaugacacaggccacgaaacagacgaaaacagggccaagguagaaaucacccccaacagcccccgcgccgaagccacccugggcggauucggcagccuaggccuagacugcgaacccagaacaggacuagacuucuccgaccucuacuaccucacaaugaacaauaaacauuggcugguacacaaggaaugguuccacgacauaccccucccuuggcacgccggagcagacaccggaacuccacacuggaacaacaaagaagcccuaguggaguucaaggacgcacacgcaaagagacaaacggucguaguacugggaucacaagaaggcgcaguccacaccgcccucgcgggagcacuagaagccgaaauggacggcgcaaaaggccgacuauccagcgggcaccuaaaaugcagacuaaaaauggacaaacuccgacuaaaaggagucaguuacagccuaugcaccgccgcauucacguucacaaaaaucccggccgagacgcugcacggcaccgucacgguugaagugcaauacgccggcacagacggccccugcaagguucccgcccaaauggccguagacaugcaaacgcuaaccccagucggccgccuuauaacggccaaccccguaaucaccgaaucaacagaaaacuccaaaaugaugcucgaacuagacccaccauucggcgacagcuacaucguaaucggcgucggcgaaaagaaaauaacgcaccacuggcaucgcagcggaagcacaaucggcaaagcguucgaagccaccguacgcggagccaaacgcauggccgugcucggcgacacagccugggacuucggaucagucggcggagcccuaaacagccucggcaaaggcauacaccaaauauuuggagcggccuucaaaucccuauucggagggaugagcugguucucccaaauccugaucggaacccuccucauguggcucggacucaacacgaaaaacggcagcauaagccuaaugugccuggccuugggcgguguacucauauuucuaagcaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5138 - RNA, 2284 nt, Artificial Sequence
  KU497555.1 prME-short mRNA Design 1 opt
gggagaaagcuuaccaugaccaguguagggauaguaggccuacuccucacaacggccauggcagcagaagucacccguagaggaagcgccuauuacauguaccuagaccgaaacgaugcgggcgaggccaucagcuucccaaccacucuaggcaugaauaaaugcuacauacaaaucauggaccucggacauaugugcgacgcgacaaugaguuacgaaugccccaugcuagacgagggcguagaaccagacgacguggacugcuggugcaauacaaccuccacaugggucgucuacggaacaugccaccacaagaaaggcgaggcccgacgcucgcgccgcgcuguaacauuacccucgcacuccacccgaaaacuccaaacacggagccaaacguggcucgaaagcagagaauacacaaaacacuuaauaagaguagaaaacuggauauuucgaaaccccggcuucgcccuagccgcggcagcgaucgcauggcuccuuggaagcagcacaagccagaaagucauauaccuagugaugauccuccucaucgcgcccgcauacucaauccggugcauaggcgucagcaacagagacuucguagaaggaaugagcggcggcaccugggucgacguagugcucgagcacggcggaugcgucaccguaauggcacaggacaaaccaaccgucgacaucgaacucgucacaaccacggucucaaacauggccgaagucagaucguacugcuacgaggccuccaucagcgacauggccagugacuccagaugccccacgcaaggggaagccuaccucgacaaacaaucagacacacaauacguaugcaaacgaacacucgucgacaggggauggggaaacggcugcggccucuucgguaaaggaucgcugguaaccugcgccaaauucgccugcagcaagaaaaugaccgggaaaagcauccaaccugaaaaccuagaauaccgcauaaugcucucaguccacgggucccagcacagcggcaugauagucaacgacacaggccacgaaaccgacgaaaacagggccaaaguagaaaucacccccaacagcccacgcgccgaagcaacgcuaggcggcuuuggaucccucggacuagacugugaaccacgaaccggccucgacuucuccgaccuauacuaucucaccaugaauaacaagcacuggcucgugcacaaagaaugguuccacgacaucccacucccauggcacgccggcgccgacaccggaacgccacauuggaacaacaaagaagcccuaguggaguucaaagacgcacacgcaaaaaggcaaacagucgucguacucggaacucaagaaggagcaguccacacagcgcucgcaggagcacucgaagcagaaauggacggggcaaagggcagacuauccagcggacaccucaagugccggcucaagauggacaaacuacgccuaaaaggcguaagcuacagccuaugcaccgcagccuucaccuucaccaagauacccgcagaaacccuacacggcacagucacaguggaaguccaauacgccggcaccgacggacccugcaaaguccccgcccaaauggcagucgacaugcagacgcucacacccguaggacguuuaaucacagcgaaccccguaauaaccgagucaaccgaaaacagcaaaaugaugcuagaacucgacccaccauucggcgacaguuacauagucaucggcguaggcgagaaaaagauaacccaccacuggcaccgaagcgggagcacaauaggcaaagccuucgaagcaaccguccgaggagccaaaagaauggccguccuaggagacaccgccugggauuucgggagcgucggcggggcacucaacagccucggaaaaggcauacaccaaauauucggggcagcauucaagagcuuguuuggagggaugucaugguucucccagauccucaucggcacccuacucauguggcuaggacuaaacaccaaaaacgggucgaucucacucaugugccuagcccucgggggcguacuuaucuuccuaucaacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5139 - RNA, 2284 nt, Artificial Sequence
  KY075939.1 prME-short mRNA Design 1 opt
gggagaaagcuuaccaugacgagcgucggcaucguaggacuacuccucacuaccgccauggcagccgaagucacaagacgaggauccgccuacuacauguaccuagaccgcaacgacgcaggcgaagcaauauccuucccaaccacgcuggguaugaacaaaugcuacauacaaauaauggaccucggacacaugugcgacgcaacaaugucguacgaaugcccgaugcuagacgaaggaguagagccagacgacgucgacugcuggugcaacacaaccuccacgugggucguguacggcacaugccaccacaaaaagggagaggcccgaagaagccgacgagccguaacccuccccucacacucgacccgcaaacuucagacacgcagccaaacauggcuagaaagcagagaauacaccaagcaccugaucaggguagaaaauuggauauuccgcaaccccggauuugcccuagcagccgcagccaucgcauggcuccugggauccagcacaucacagaaaguaauauaccuuguaaugauccuacuaaucgcaccagccuacucccuccggugcauaggcgucagcaaccgcgacuucgucgaaggcaugucaggcgggaccuggguagacguaguacucgaacaugggggaugcgucaccguaauggcacaggacaaaccaaccgucgacaucgagcugguaaccacaacaguaagcaacauggcagaagugcgcucauacugcuacgaagcauccaucagcgacauggccagcgacucccgcugcccaacacaaggcgaagccuaccuagacaaacaaagcgacacccaauacgucugcaagagaacccucguagaccgaggcugggguaacggcugcggacucuucggcaaaggcucacucgugacuugcgccaaguucgcaugcagcaagaaaaugacaggcaaaagcauacaaccagaaaaccuagaauacagaaucaugcucagcguucacggaucccaacacuccgggaugaucgucaacgacacaggccacgaaacagacgaaaaccgcgcaaaagucgaaaucacaccaaacagcccacgcgcagaagcaacacuuggcggauucggcagccucgggcuagacugcgaaccccgaacgggccuggacuucagcgaccuauacuaccuaaccaugaacaacaaacacuggcuaguccacaaagaaugguuccacgacaucccccucccauggcacgccggagccgacacaggaacaccccacuggaacaauaaagaagcccuaguagaguucaaagacgcccacgccaaacgccaaacaguaguaguucuagggagccaagaaggagcaguccacacagcgcucgcaggcgcccuggaggcagaaauggacggagccaaaggacggcucuccagcggacaccuuaagugccggcuaaaaauggacaaacucagacucaaaggcguaucuuacaguuuauguaccgccgccuuuacauucaccaagauccccgcugaaacacuucacgggaccgucacagucgaaguccaauacgcggguaccgacggaccaugcaagguccccgcgcaaauggcaguagacaugcagacauuaacacccguaggccggcuuaucacagcaaacccaguaaucacagaaucaacagaaaacucaaaaaugaugcucgagcuagacccgcccuucggggacucauacaucgucaucggagucggagagaaaaagaucacacaccacuggcaccgcagcggcagcacgaucggaaaagcguucgaagccacugugcgcggagcgaaaagaauggcaguacugggagacacugcgugggacuucggcucagucggaggggcacuaaacagccugggcaaaggaauacaccaaauauucggcgcggcauucaaaucccucuucggaggaaugaguugguucucacaaauccugaucggcacccuacucauguggcugggucucaacaccaaaaacgggucaauaagccucaugugccucgcacuaggcggaguacuaaucuuccucaguacagcaguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5140 - RNA, 2284 nt, Artificial Sequence
  KY075932.1 prME-short mRNA Design 1 opt
gggagaaagcuuaccaugaccuccgucgggauaguaggccuacuacucaccaccgcuauggcagcagaaguaacccgaaggggcagcgcauauuacauguaccuagacagaaacgacgccggcgaagcgaucaguuucccgacaacgcugggaaugaacaaaugcuacauacaaaucauggaccucggacacaugugugacgccaccaugucauacgaaugcccgaugcucgacgagggagucgaacccgaugauguagacugcuggugcaacacaacaagcacuugggucgucuacgggaccugccaccacaagaaaggcgaagcacgucgcagccgcagagcuguaacccucccaucgcacagcacacgcaaacuccaaacccgcucccaaacguggcuggaaucccgcgaguacaccaaacacuuaaucagaaucgaaaauuggaucuuccgcaaccccggcuucgcacucgcggcagccgccauagcguggcuccuaggcucauccacgagucaaaaaguaauauaccucgucaugauccuacuaauagcccccgccuacuccauacgcugcauaggcgucagcaaccgagacuucguagaaggaaugucuggaggcaccugggucgacguaguacuggaacacggcggcugcgucacggugauggcacaagacaaaccgaccguagacaucgaacucgucaccaccacaguaagcaacauggcugagguccgcucguacugcuacgaggcaagcauaagcgacauggcaucagacuccaggugccccacccaaggagaagccuaccucgacaaacaaagcgacacccaauauguaugcaaaaggacccuagucgaccgcggguggggaaacggcugcggacuauucggcaaaggaagccucguuaccugcgcaaaauucgcaugcuccaagaaaaugaccggcaaaucuauacaaccagaaaaccucgaauacagaauaaugcuaucaguccacggcucacaacacagcggcaugaucgucaaugacaccggccacgaaaccgacgaaaacagagcaaaaguagaaaucacccccaacagcccacgagccgaggccacccucggcggcuucggaucgcuggggcuagacugcgaacccagaacaggccucgacuucucugaccuauacuaccuaacgaugaacaacaaacacuggcucguccacaaagaaugguuccacgacaucccacuaccauggcacgcaggcgcagacacaggaacaccccacuggaauaauaaagaggcacuugucgaguucaaagacgcacacgccaaaagacaaaccgucguaguccucggcagccaagaaggugcuguacacaccgcacucgccggcgcccucgaagcagaaauggacggcgcaaaaggccgccuaucaucaggccaccuaaaaugccgccucaaaauggacaaacuccgacuaaaaggcgucagcuacucgcucugcaccgcggccuucaccuucaccaaaauccccgcagaaacccuacacggaaccgugaccgucgaaguccaauacgcaggaaccgacggaccaugcaaagucccagcacaaauggccgucgacaugcagacacuaacaccaguaggcagacucauaacugccaacccaguaaucacagaauccaccgaaaacaguaaaaugaugcucgaacuagacccgccauucggcgacagcuacaucgucaucggcgucggggaaaagaaaaucacacaucacuggcaccgcucaggauccacaaucggcaaagccuucgaagccacaguccgaggggcuaaaagaauggcaguccucggcgacaccgcaugggacuucggcagcguaggcggcgcccuaaacucacucggaaaaggcauucaccaaauauucggcgcagcauucaaaucacuuuucggaggaaugagcugguucucacaaauacuaaucggaacacuacuaauguggcucggacucaacaccaaaaacggguccauaagccugaugugucuagcccuaggaggaguacucaucuuccuaagcaccgcagucuccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5141 - RNA, 2284 nt, Artificial Sequence
  KU870645.1 prME-short mRNA Design 1 opt
gggagaaagcuuaccaugacaucagugggaauaguaggacuccuacuaacgaccgcaauggccgcagaaguuacccgaagaggcagcgcauacuauauguaccucgaccgcaacgacgccggcgaagccaucucauucccaaccacacucgggaugaacaaaugcuacauccaaauaauggaccuaggacacaugugcgacgcgaccaugucauacgagugucccaugcuugacgaaggcguagaaccggacgacguagacugcuggugcaacaccacgagcaccugggugguauacggcaccugccaccacaaaaaaggcgaggcgagaaggagcagacgagccgucacccuucccagccauucaacccgaaaacuacaaacaagaagucaaacguggcuagaaucacgcgaauacacaaaacaccugauccgcguagaaaacuggauccuaaggaacccaggauucgcacuggccgccgcggccaucgccuggcuccuagggagcagcacaucccaaaaaguaaucuaccuagucaugauccuccugauagcgcccgcguacagcaucagauguaucggcgucuccaaccgagacuucguagaaggaaugucuggggguacaugggucgacgucguccuagaacacggcggcugcgucacaguaauggcacaagacaaaccaacgguagacauagaacucgugaccaccaccgucucaaacauggcagaaguacgaucguacugcuacgaggcguccauaucagacauggccagcgacagccgcugcccaacccagggagaggcauaccucgacaaacaauccgacacccaauacgugugcaaaaggacacuagucgaccgggggugggggaacggcugcggccucuuuggaaaaggcagccucgucacaugcgccaaauucgccugcuccaaaaaaaugacagggaaaagcauccaaccagaaaaccuagaauaccgaaucaugcucuccgugcacggcucacaacacuccgggaugauaguaaacgacacaggacacgagaccgacgaaaaccgagccaaaguugaaauaacccccaacagccccagagcugaagccacacuuggaggauucggaucccuaggccucgacugcgaaccacgcacgggccucgacuuuagcgaccuauacuaccuaaccaugaacaacaaacacuggcugguccacaaagaaugguuccacgacaucccgcugccauggcacgccggcgccgacacgggaaccccccacuggaacaacaaagaggcacucgucgaauuuaaagacgcacacgccaaacgacaaaccgucguuguacuaggcucacaagagggcgcgguccauacagcacuagcaggcgcccuggaggccgaaauggacggagccaaaggccgacucuccagcggacaucuaaaaugccgacugaagauggauaaacuacgacucaaaggagucucauacucacuauguaccgcagcauuuacauucacaaaaauacccgcagaaacacuacacggaaccguaaccgucgaaguccaguacgccggcacggacggccccugcaaaguccccgcccaaauggccgucgacaugcaaacacugaccccagucggccgccucauaaccgcaaacccagucaucacugaauccaccgagaacagcaaaaugaugcucgagcucgacccccccuucggcgacagcuacaucgucaucggcaucggggaaaagaaaauaacacaccacuggcaccgauccggcagcaccaucggcaaagccuucgaggcaacaguccgcggagcaaaacgcauggcaguccucggagacaccgccugggacuucggcagcgucggaggagcccucaacucucugggcaaagggauacaccaaaucuucggagcagcauucaaaagccuauucggcggaaugagcugguucucccaaauacucauaggaacccuccucauguggcucggacuaaacaccaaaaacggauccauaagccuaaugugccuagcucucggaggcgugcuaauauucuuaaguaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5142 - RNA, 2284 nt, Artificial Sequence
  KU729217.2 prME-short mRNA Design 1 opt
gggagaaagcuuaccaugaccuccguaggaaucgucggccuccugcuaaccaccgccauggcagccgaagucacacgccgcggcucagcauacuacauguaucucgacagaaaugacgccggugaagccauaucauuccccaccacacugggcaugaauaagugcuacauccaaaucauggaccugggccacaugugcgacgccacaauguccuacgaaugucccaugcucgacgaaggcgucgagcccgacgacguagacugcuggugcaacaccacuagcacgugggucgucuacggaaccugccaccacaagaaaggcgaagcccgccgaucaagaagggcagucacccuucccucacacagcacccgaaaauuacaaacaagaagccaaacauggcucgaaagccgcgaauacacaaaacaccuuauccgcguagagaacuggaucuuccgcaaccccggcuucgcccucgccgccgccgccaucgccuggcuacuuggcucauccaccagccaaaaagucaucuaccuagucaugauccuacucaucgcacccgccuacuccauccgaugcaucggcguauccaaccgcgacuucgucgaaggaaugaguggcggcaccuggguagacguuguccucgaacacggcggaugcguaaccgucauggcccaagacaaaccgaccgucgacauagaacucgucucaaccaccguaagcaacauggcagaaguaagaucauacugcuacgaagcaaccauaagcgacauugcgucggacucccgcugcccaacucagggcgaagccuaccuagacaaacaaucagacacccaauacgugugcaaacgaacccucguggauagaggcuggggcaaugggugcgggcuuuucgggaaaggcucccuggucacaugcgccaaauucgccuguagcaagaaaaugacaggcaaauccauccaaccggaaaaccucgaauaccgcaucaugcuaucaguacacggcagccaacacagcggcaugauuguaaacgacacaggacacgaaaccgaugaaaaccgagccaaagucgaaauuacccccaacucaccccgcgccgaggcaacccuuggaggcuucggcucccucggacuggacugcgaaccaagaacaggccucgacuuuuccgaccucuacuaccuaaccaugaacaacaaacacuggcucguacacaaggaaugguuccacgacaucccccuucccuggcacgcgggagcggacaccggcaccccacacuggaacaacaaagaagcgcuggucgaguucaaagacgcccaugccaaacgccaaacagccgucgugcucgggagccaagaaggagcaguucacaccgcccuagccggcgcccuggaagcagaaauggacggcgccaaagggcgacucuccuccggccaccucaaaugccgacuaaagauggacaaauuacgccuaaaaggagucuccuauagccuaugcacagccgcauucacauucacaaagauacccgcagaaacccuccacggcaccguaaccgucgaaguacaauacgcaggaacggacggaccaugcaaaguacccgcccaaauggcagucgacaugcaaacccuaacccccgucggacgacucauaaccgccaacccagucaucacagaaagcaccgaaaacucaaaaaugaugcucgaacucgacccacccuucggcgacucauacaucgucaucggcgucggagaaaagaaaauaacccaccacuggcaccgcuccggcagcacgaucgggaaagcauucgaagccacaguccgaggagccaagcgaauggcaguccuaggcgauacagccugggacuucggcucaguagguggcgcccuaaacucacucggaaagggaauccaccaaauauuuggcgccgcauucaaaucccuauucggcggcauguccugguucagccagauauuaauaggaacacuacucauguggcuagggcucaauaccaaaaacggcuccaucucgcuaaugugccuagcccucgguggcguacucaucuuccucagcaccgcagucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5143 - RNA, 2284 nt, Artificial Sequence
  KX087101.3 prME-short mRNA Design 1 opt
gggagaaagcuuaccaugacaagcguuggaaucguaggacuacuacugaccaccgccauggcugccgaagucacacgccgaggcucagccuacuacauguaccucgaccgaaacgacgccggugaagcaauaucauucccaaccacacucggcaugaacaaaugcuacauccaaaucauggaccucggacacaugugcgacgccaccaugagcuacgaaugucccaugcuagaugagggcgucgaaccagacgaugucgacugcuggugcaacaccaccuccaccugggucguguacgguaccugccaccacaagaaaggcgaagcccgacgaucacgacgcgcagucacacucccaagccacagcaccaggaaacuccaaacacgcagccagacauggcucgaaagccgcgaauauacaaaacaccuaauaagaguagaaaacuggaucuuccgaaacccaggcuucgcccucgcagccgccgcgaucgcauggcuacucgggagcucaaccucccaaaaagucaucuaccuaguuaugauacuacuaauagcacccgcuuacuccauccgaugcauaggcgucucaaaccgcgacuucgucgaaggaaugagcggaggcaccuggguagacguaguccucgagcacggagguuguguaaccgucauggcucaagacaaaccaacggucgacauagagcuaguaacaacaaccgucucaaacauggcagaaguccggagcuacugcuacgaagccagcaucuccgacauggccucugauucccgcugcccaacacaaggcgaggcuuaccuagacaaacagucagacacccaguauguuugcaaacggacacucgucgaccgaggguggggcaacggaugcggccucuucggcaaaggcucccucguaacaugcgcaaaauucgcuuguucaaagaaaaugacaggcaaaucaauccaaccggagaaccucgaauaccgcaucaugcucagcguccacgggagccaacacuccggaaugauagucaacgacaccggacacgaaaccgacgaaaaccgagcaaaaguggaaaucacgccuaacagcccccgggccgaagcaacccuaggaggcuucgggucccuggggcuugacugcgaaccucguaccggccuagacuucagcgaccucuacuaccuaaccaugaacaacaaacauuggcuaguacacaaagagugguuccacgacauccccuuacccuggcacgccggagcagacaccggcacaccccacuggaacaacaaagaagcccucguugaguucaaagacgcacacgcaaaacgccaaaccguagugguucuaggaucccaagaaggagccguccacaccgcccucgccggagcacucgaagccgaaauggacggcgcaaaaggcaggcucagcagcggacaccucaaaugccgacuaaaaauggacaaacuccgacucaaaggcguguccuacucccugugcacagccgccuucaccuucaccaaaauccccgccgaaacacuccacggcacgguaacaguagaacuacaauacgccgggacagauggaccaugcaaaguccccgcacaaauggcaguagauaugcaaacacuaacccccguaggccgccuuaucaccgcaaaccccgucaucaccgaauccacagaaaacuccaaaaugaugcuugaacucgacccaccauucggcgauucauacaucgucauaggcgucggagaaaagaaaaucacgcaccacuggcacaggagcggcuccaccauaggcaaagcguuugaagccaccgugcgcggcgccaaacgaauggcaguccucggagacacagccugggacuucggcuccguuggcggggcacuaaacucacucggcaaaggcauccaccaaaucuuuggagccgcguucaaaucacucuucgguggcaugucuugguucucucagauccuaaucggcacucuucucauguggcuaggacucaauaccaaaaacggcucgaucagccucaugugccucgcacucggcggcguacucauuuuccucagcacagccgucucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5144 - RNA, 2284 nt, Artificial Sequence
  KY014317.1 prME-short mRNA Design 1 opt
gggagaaagcuuaccaugacauccguaggaaucgucggacuccugcucacaaccgccauggccgccgaagucacaagacgaggcuccgcauacuacauguaccucgaccgcaacgacgccggcgaggcaaucagcuucccaaccacccucggcaugaacaaaugcuacauacaaauaauggaucuaggacacaugugcgacgccacgaugagcuacgaaugccccaugcuggacgaaggaguggagccagacgacgucgacugcuggugcaacaccacaagcacauggguuguauacggaaccugccaccacaagaaaggcgaggcccgccgcagcagacgagcaguaacucuaccaucccacuccacacgcaaacuccaaacucgaucccagaccuggcucgaaagccgagaauacacaaaacaucucauacgcgucgaaaacuggauauucagaaacccaggguucgcacucgccgccgccgccaucgccuggcuccuaggcagcagcacaucccaaaaagucaucuaccuaguaaugaucuuauuaauagcccccgcguacuccauacggugcaucggaguaucaaaccgagacuucguagaaggaaugagcgggggcacgugggucgacguuguccucgaacacggcggcugcguaaccguaauggcccaagacaaaccaacaguagacauagaacucgucaccacaaccgucagcaacauggccgaagugcgcucauacugcuacgaagccuccauuuccgacauggccucugacaguaggugcccaacgcagggagaagcauaccuagacaaacaaagcgacacccaauacgucugcaagcgcacucuagucgaccgaggauggggaaacgggugcggucuauucggaaaaggcagucuuguaaccugcgcaaaauucgcuugcuccaagaaaaugacaggcaaaagcauacaacccgaaaaccucgaauaccgcaucaugcucuccguccacggcucacaacacucagggaugaucgucaaugacacaggccaugaaaccgacgaaaaccgggccaaagucgaaaucacccccaacagccccagagccgaagcaacccuaggaggcuucggcagccuaggccucgacugcgaaccucgcaccggucuggacuucuccgaucucuacuaccucaccaugaacaacaaacauuggcucguccacaaagaaugguuccacgacaucccccucccauggcacgccggagccgacacaggaacaccacauuggaacaacaaagaagcacuggucgaguucaaagaugcccaugccaagagacagaccgucgugguccucggcucacaagaaggcgccguacacaccgcacucgccggagcgcucgaagccgaaauggacggagccaaagguaggcuaagcuccggacaccugaaaugcagacuuaaaauggacaaguuacgccucaaaggcgucucauacucccuuugcacagccgcauucacuuucacaaaaauccccgccgaaaccuuacacgggacaguaacuguggaagugcaauacgccggcaccgacggaccgugcaagguccccgcgcaaauggcagucgacaugcaaacacuaacacccguaggccgccugaucacagcaaacccuguuaucacagaaucaauagaaaacuccaaaaugaugcuugaacucgacccaccguucggagacagcuacaucguaauaggcgucggcgaaaagaaaauuacccaccacuggcaccgcucaggcagcacaaucggaaaagccuucgaagccacaguccggggcgccaaacgaauggccguccucggcgacaccgcaugggacuucggaucaguaggaggcgcacucaacagucuugggaaaggaauccaccaaauauucggagccgccuucaagagccucuucggaggcauguccugguuuagccaaauacuaauaggcacacuccuaauguggcuaggccucaacaccaagaacggcagcaucagccucaugugccucgcccucggaggaguacuaauauuccuauccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5145 - RNA, 2284 nt, Artificial Sequence
  KU758876.1 prME-short mRNA Design 1 opt
gggagaaagcuuaccaugacaaguguaggaaucgugggucuccuccugacaaccgcaauggccgcagaaguaacacggcggggguccgcauacuacauguaccucgaccggaacgacgcaggcgaggccaucucuuuccccaccacccuaggcaugaacaaaugcuacauccaaauaauggaccuaggacacaugugcgacgcaaccauguccuacgaaugccccaugcuagaugaaggagucgaaccagacgacguggacugcuggugcaacaccaccaguaccugggucgucuacggaacaugccaccacaagaaaggggaggcucgcagaagccgccgagcugucacacucccaagccacagcaccagaaaacuccaaacacgaucccaaacauggcuagaaucgcgcgaguacaccaaacaccucauccgcguggaaaacuggaucuuccgaaacccaggcuucgcccucgcagcggcagcaauagcauggcuguuaggauccuccacaagccaaaaaguaauauaccugguaaugauccuacucaucgcacccgcauacuccauccgaugcauaggaguauccaaccgggacuucgucgaaggaaugagcggaggaaccugggucgacgugguccuagaacacggcggaugcgucaccgucauggcacaagacaaacccacaguggacaucgagcuaguaaccaccaccgugucaaacauggcugaaguuagauccuacugcuacgaagcaagcaucagcgacauggcgagugacagcagaugccccacacaaggcgaagcauaccucgacaaacaauccgauacccaauacguaugcaaacgcacacucguagaccgcgguuggggcaacggcugcggauuauucgggaaagggagccucguuaccugcgcaaaauucgccugcagcaaaaagaugacaggcaaaagcauccaacccgagaaucuagaauacagaauaaugcucuccguacacggaucccaacacucagggaugauaguuaaugacacaggccacgaaacagacgaaaaccgagccaaaguugaaauaaccccgaacucaccaagagccgaagccacccuaggaggcuucggaucucucggacucgacugcgaaccccgcacaggacuagacuucuccgaccuauacuaucucacuaugaacaacaagcacuggcucguacauaaagaaugguuccacgacaucccacuacccuggcacgcgggcgcagacacagggacgccccacuggaacaauaaagaagcgcucguagaguucaaggaugcucacgccaagcgccaaacagucguaguacuaggcucccaagaaggcgccguccacacagcccuagcaggagcccuggaagccgaaauggacggaguaaagggcagacucucuagcgggcaccuuaaaugccgacugaaaauggacaaacucagguuaaagggcguauccuauucacugugcaccgcggcauucacauucaccaaaaucccggccgaaacacuccacggcacaguaacggucgaaguccaauacgccggcacggacggacccugcaaaguacccgcccaaauggcagucgacaugcaaacccucacacccgucggaaggcuaauaacagccaaccccgucaucaccgaaagcaccgaaaacagcaaaaugaugcucgaacuagacccacccuucggcgacucauacauagugaucggcgucggcgaaaagaaaaucacgcaccacuggcacagaucaggaucgacaauaggaaaagccuucgaagcgacaguccgcggagcaaaacgaauggccguauuaggggacacagcaugggacuucggcuccgucggcggcgcacucaacucccucgguaaaggaauacaccaaauauucggugcagcuuucaaaucacuauucggcggcauguccugguucagccaaauucucaucggaacacuccucauguggcucggccuuaacacuaaaaauggcucaaucucguucaugugccucgcccuaggcggaguccugaucuuccucuccaccgcgguauccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5146 - RNA, 2284 nt, Artificial Sequence
  KU758874.1 prME-short mRNA Design 1 opt
gggagaaagcuuaccaugacaagcguaggaauagucggacuacuacucacaacggcaauggcagccgaagucacccgaagagggagcgccuauuacauguaccuagacagaaacgacgcaggagaagcaaucucauuccccacgacacucgggaugaacaaaugcuacauacaaauaauggaccuaggacauaugugcgacgcgacaaugucauacgaaugcccaaugcucgacgaaggaguggaacccgacgacguagacugcuggugcaacaccacauccaccugggugguauauggcacaugccaccacaagaaaggcgaagcacgccgaagccgccgagcagucacacucccaagccacagcacccgcaaacuccagacaagaagccaaacauggcuagaaucccgagaauacacuaaacaccuaauacggguagaaaacuggauauucagaaacccaggauucgcacuugcagccgcagccaucgcuuggcuccuaggaagcuccacgucccaaaaagugaucuaucucgucaugauacuacugaucgcccccgccuacagcauacgcugcauaggcguaagcaaccgagauuucguggaaggaaugagcggcggcaccuggguagacgucguucuagaacacggaggcugcguaaccguaauggcccaagacaaacccaccguggacaucgaacugguuacaaccaccguauccaacauggccgagguuagaagcuacugcuacgaagcguccaucucagacauggccucagacucacgcugccccacacaaggagaagcauaccucgacaaacaaucagauacgcaguacgucugcaaaagaacacugguggaccgcggcuggggaaacggaugcggccuguucgguaaaggcagccucgucacaugcgcaaaauucgcgugcucgaaaaagaugacaggcaaaagcauacaacccgaaaaccuagaauaccgaaucaugcuauccguccacggcucacaacacucuggaaugaucgucaacgacacgggccaugaaacggacgaaaacagagccaaagucgagauaacacccaacagccccagggccgaagcgacacucggaggcuucgguagccugggacuagacugcgaaccgcgcacaggccuggacuucagcgaccuuuacuaccugaccaugaauaacaaacacuggcucguccacaaggaaugguuccacgacaucccccugccauggcaugccggcgcagacaccggcaccccacacuggaacaacaaagaagcccuaguagaguucaaagacgcacacgcaaaacgccagacaguaguaguccugggcucacaggaaggcgcagugcacaccgcacuggcaggcgcgcuggaagccgagauggacggcgccaaagguaaacuaucuucgggccaccucaaaugccgucuaaaaauggacaaacuaagacuaaaaggggucuccuacagccucugcaccgcagccuucaccuuuacaaaaauaccagcagaaacacuccacgggacaguaaccgucgaagugcaguacgccggcacagacggccccugcaagguccccgcacagauggcagucgacaugcagacacucaccccaguaggacgccucauaaccgcaaaccccgucaucaccgaaagcaccgagaacaguaaaaugaugcucgaauuggacccaccauucggagacagcuacaucguaauaggaguuggcgaaaagaaaaucacacaccauuggcacagaagcgggagcaccauaggcaaagcauucgaagccacgguccgaggcgcaaaacggauggcagugcuaggcgacaccgcaugggacuuuggaagcgugggcggagcacugaacagucuaggaaaaggcauacaccagauauucggagcagcguucaaaagccuguuuggcggaaugucaugguucucgcaaauccucauaggcacccuacuuauguggcuagggcucaacaccaaaaauggaagcaucagccuaaugugccuagcacuagggggcguccuaauauuccucagcaccgccguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5147 - RNA, 2284 nt, Artificial Sequence
  KY317939.1 prME-short mRNA Design 1 opt
gggagaaagcuuaccaugacgagcgucggaaucgucggacuccuccuaaccaccgcaauggcggccgaagucacccgccgaggcagcgcauacuacauguaccuagaccgaaaagacgccggagaagcgaucagcuuccccaccacacuaggaaugaacaaauguuacauacaaaucauggaucugggacacaugugcgacgccaccaugagcuacgaaugccccaugcucgacgaaggcguagaaccggacgacguagacugcuggugcaacaccaccagcaccugggucguauacggaaccugccaccacaagaaaggagaagcacggcgaagccgacgcgccgucacacuccccucacacagcacccgcaaacuccaaacccgaucccaaaccuggcucgagagcagagaauacacgaaacacuuaauacgaguagagaacuggauauuccgcaaccccggauucgcacuagcagcagccgccaucgccuggcuacucggcucauccacaucacaaaaagucaucuaccuggucaugauacuacuaauagcacccgccuacagcauacgcugcauaggaguaagcaaccgcgacuucgucgaaggaauguccggcggcaccuggguagacguaguccuggagcacggcggcugugucaccguaauggcacaagacaaacccaccguagacaucgagcuaguaacaaccaccgucaguaacauggcagaaguacgauccuacugcuacgaagcaagcaucuccgacauggcgucagacucccggugucccacgcaaggagaagcauaccucgacaagcaaagcgacacacaauacgucugcaaacgaacccucgucgaccgaggauggggcaacgguugcggccuguucggaaaaggaucccucgugaccugcgcaaaauucgcaugcagcaagaaaaugaccggcaagagcauccaacccgaaaaccuagaauaccgcaucaugcugucaguccacggcagccaacacagcgggaugauagucaacgacacuggccacgaaaccgacgaaaacagagcaaaaguggagauaaccccaaacagcccccgagccgaggcaacacucggaggauucgggagccucggccucgacugcgaacccaggaccggacucgacuucagcgaccucuacuaccugaccaugaacaacaaacacuggcucguccacaaagaaugguuccacgacauaccucugccuuggcacgcaggcgccgacacgggaacuccacacuggaacaacaaagaagcccucguagaguucaaggacgcccacgcgaaaaggcaaacgguaguuguacuaggcagucaagaaggcgcaguacacaccgcccuagccggcgcccuagaagccgaaauggacggcgccaaaggccgucuauccagcggacacuuaaagugccgacuaaaaauggacaaacuucgccucaaaggggucucauacagucucugcaccgcugcguuuaccuucaccaaaauccccgcagaaacacuccacggaacugucacagucgaagugcaauacgccgggacagacggccccugcaaaguaccagcacagauggccgucgacaugcagaccuuaacaccugucggaagacucaucacagccaaccccgucauaaccgaauccacagaaaacagcaaaaugauguuagaacucgacccucccuucggagacucauacauaguaaucggcgugggcgaaaagaaaaucacccaccacuggcacagauccggauccaccaucggaaaagccuucgaagccaccguccgaggcgccaaacgcauggccguauugggagacacagcaugggacuucggguccguaggaggcgccuuaaacucgcuagggaaaggcauccaccaaaucuucggagccgccuucaaaagccucuucgguggcaugagcugguucucccaaauccucaucggcacgcuccuaauguggcuaggucugaacaccaagaacggcucaauaucccuaaugugccucgcacuaggcggaguccuaauauuccuaucaaccgccgucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5148 - RNA, 2284 nt, Artificial Sequence
  KY014314.1 prME-short mRNA Design 1 opt
gggagaaagcuuaccaugaccuccgugggaaucguaggacugcuacucacaacagccauggcagcagaagucacccgaagaggcucugcguacuacauguaccuagaccgcaacgacgccggggaagcgauaucauucccaacaacacucggcaugaacaaaugcuacauccaaauaauggaccuaggccacaugugcgacgccacaaugagcuacgaaugcccaaugcucgacgaaggaguggagccagaugauguggacugcuggugcaacacgaccucaaccuggguaguauacggcacaugccaccacaaaaagggcgaggcccgcagaagccgcagagcagucacccuacccucacacucuacaagaaaacuacaaacacgcucccaaacauggcuagaaagcagagaauacacaaaacaccuaauacgaguagagaacuggaucuuccgaaacccaggcuucgcauuggcagccgccgcaaucgcuuggcuacuaggguccagcaccagccaaaaagucaucuaccuaguuaugauacuccucaucgccccagccuacagcauccgaugcauugguguaucaaacagggacuucguagaaggaaugagcggcggaacauggguagacgugguccucgaacacggcggcugcguaacgguaauggcccaagacaaacccacaguagauauagagcuagucacaacgacaguaagcaacauggccgaaguaagaagcuacugcuacgaagcaagcauaagcgacauggccucggacuccaggugccccacgcagggcgaagcauaccuagacaagcagagugacacccaauacgucugcaagcgcacgcuaguagacagaggauggggaaacgguugcggccuauucggaaaagggucacucgugaccugcgcaaaguucgccugcaguaaaaagaugacaggcaaaagcauacaacccgagaaccuggaauaccguaucaugcucagcguacacggcucacaacauagcgggaugauagucaacgacacaggccacgaaacggacgagaacagagcaaaagucgaaauaaccccaaacucaccccgagcagaagcaacccuaggcggcuucggaucccugggacuagacugcgaacccagaacaggccuugacuuuuccgaucuguauuaccugacaaugaacaacaagcacuggcuaguacacaaagaaugguuccacgacauaccccuacccuggcacgcaggcgccgacaccggcacaccccacuggaacaacaaagaagcccucguagaguucaaagaagcccacgcaaagcgccaaacgguagucguacuggggagccaagagggagccguacacacagcgcuagcgggagcacucgaagcagaaauggacggggccaaagggagacuuagcagcggccaccuaaaaugccgacuaaaaauggacaaacuccgccuaaagggaguaucauacucccugugcacagcagcauucaccuucaccaagauccccgcagaaacacuccauggcacagucacaguagaaguacaguacgccggcaccgacggacccugcaaaguaccagcacaaauggccguagacaugcaaacacuaaccccaguaggcagacucaucacagcuaauccaguaauaacagaaagcaccgagaacaguaaaaugaugcuggagcucgacccgcccuucggcgacuccuacaucguaauaggagugggcgagaaaaagauaacacaccauuggcacagaagcggcagcaccauaggcaaagcauucgaagcgacggugcgcggggcuaaacgcauggcagugcuaggcgacaccgcgugggacuucggcucaguaggaggggcacuaaacucacucggaaaaggcauacaccagaucuucggagcagccuuuaagagccucuucggaggcaugagcugguucucgcaaauacucaucggcacacuucucauguggcucgggcuaaacaccaaaaacggaucaaucagccucaugugccuagcacuaggagggguccucaucuuccuaagcacggcggucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5149 - RNA, 2284 nt, Artificial Sequence
  KX447517.1 prME-short mRNA Design 1 opt
gggagaaagcuuaccaugaccagcguuggaauagucggccuacuacuaaccacagcaauggccgccgaagucacacgcagaggguccgcuuacuacauguaccuagaccgaaacgacgcgggcgaagcaaucagcuuccccaccacccucggaaugaacaaaugcuacauccaaaucauggaccuaggacacaugugcgacgcgacuaugaguuacgaaugccccaugcucgacgaaggagucgaaccggacgacguagacugcuggugcaacaccacguccaccuggguaguauacggaaccugccaccacaagaaaggcgaagcacgccgaagccgccgcgccgucacgcugccaucucacucaacacgaaaacuacaaacacgaagucagacauggcuagagagccgcgaguacaccaaacaccugauaagaguugaaaauuggauauucagaaacccaggcuucgcgcuggcggcagcagccaucgccuggcuccucggaucauccaccagccagaaagucauauaccuaguaaugauccuccucaucgcaccagcguacagcauccgcugcaucggcguaagcaaccgcgauuucguagaaggcaugagcggaggcaccuggguagacguaguacucgaacacggaggaugcguaaccgucauggcccaagacaaacccacagucgacaucgaacucgucaccaccacaguaagcaacauggccgagguccgcagcuacugcuacgaggcaagcaucagcgacauggcaucggacucccgaugcccaacccaaggggaagcguaccuagauaaacaaagcgacacacaauacgucugcaaacgcacacuuguagaccgaggaugggguaacggaugcggacucuuuggcaaaggcagccucgucacaugcgccaaauucgcaugcucaaagaaaaugacaggaaaauccauccagcccgagaaccuggaguaccgcaucaugcucaguguccacgggagccaacacucaggcaugaucgucaacgacacgggccacgaaaccgacgaaaaccgagccaaagucgaaaucacccccaacucgccaagagcagaagccgcccucggcggcuucggaucacucggacuggacugcgaacccagaacuggacucgacuucucagaccucuacuaccucaccaugaacaacaaacacuggcucguccacaaagaaugguuccacgacauaccccuacccuggcacgccggugcugacacaggcacuccacacuggaacaacaaagaagcccuaguagaguucaaagacgcacacgcaaaacgccaaaccguagucguacuagggagccaagaaggcgccguacacaccgcacuagcaggcgcacuagaagcagaaauggacggcgcaaaaggcagacugucuagcggccacuuaaaaugccgucucaaaauggacaaacugagacucaaaggaguaagcuacucccuaugcacagcagcauucacauucacaaaaauacccgcagaaacacuacacggcacaguaaccgucgagguacaauacgcagggacagacgggcccugcaaagucccagcacaaauggccguggauaugcaaacccucacacccguaggacgacuaauaaccgcaaacccagucauuacagaauccaccgaaaacagcaaaaugaugcucgaacuagacccaccauucggcgacucauacaucgucauaggagucggggaaaagaaaaucacacaccacuggcaccgcagcgggucgaccaucggcaaagccuucgaagcgacaguuagaggggcaaaaaggauggccguccuaggcgacaccgcgugggacuucggcuccguaggcggagcccuaaacagucucggcaaaggaauacaccaaaucuucggagcagcguucaaaucacuauuuggcggcaugucuugguucucacaaacccuaaucgggacccuccucauguggcucggccuaaacaccaaaaacggcuccaucagccucaugugcuuagcccucggcgggguccuaauauuccuuuccacagcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5150 - RNA, 2284 nt, Artificial Sequence
  KU926310.1 prME-short mRNA Design 1 opt
gggagaaagcuuaccaugaccagcguaggaaucgucggccuccuacuuaccaccgcaauggccgcagaagucacccgucgaggcucagccuacuacauguaccucgacagaaacgacgccggcgaagccaucagcuuuccgacaacgcuuggcaugaacaaaugcuacauacaaauaauggaccucggccacaugugcgacgcaacgaugucauaugaaugcccaaugcuagacgaaggcguagaaccagacgacgucgacugcugguguaacacaacauccaccuggguggucuacggaaccugccaccacaagaaaggagaagcucgacgaagccgacgcgccguaacacugcccagccauuccacgcgcaaacuccaaacacgcucccaaaccuggcuugagagccgagaguacacaaaacaccuaauacgcguggaaaacuggauauuccgaaaccccggcuucgcacucgccgcagccgcaauagcguggcuucuaggaagcuccaccucacagaaagugauauaucugguaaugauacugcucauagcacccgccuacagcauaagaugcaucggcgucucaaacagggacuucgucgaaggaaugagcggagggacgugggucgacgucguccuagaacacgggggcugcguaacagucauggcgcaagacaagcccacgguagacaucgaacuggucaccaccacagucucaaacauggccgaaguacgcuccuauugcuaugaagccucaaucucagacauggcguccgacagccgcugccccacccaaggcgaagccuaccucgacaaacaaucggacacccaauacgucugcaaaagaacacuuguagacaggggauggggcaacggaugcggacucuucggcaagggcagccuaguaacaugcgccaaauucgccugcucaaagaaaaugaccggaaaguccauccaacccgaaaaccuagaauacagaaucaugcuauccguacacggcagccaacacuccggcaugaucgucaacgacaccggccacgaaacagacgaaaaccgagccaaggucgaaauaacccccaacucacccagggcggaagcaacacuuggcggauucggcagccucggccuagacugcgaaccacgcaccggccuagacuucagcgaccucuacuaccuaacaaugaacaacaaacacuggcucguacauaaggagugguuccaugacauaccgcuacccuggcacgcaggcgccgacaccggaaccccacacuggaacaacaaagaagcgcucgucgaguucaaagacgcccacgccaaacgccagaccguagucguccuaggaucacaagaaggcgcuguacacacagcccucgccggagcccucgaagccgaaauggacggagcaaaaggccgccucagcagcgggcaccuaaaaugccgacuaaaaauggacaaacuccgucucaaaggaguaagcuacucccucugcacagccgcuuucaccuucacaaaaauaccagccgaaacccuccacggcaccgucacaguagaaguccaauacgcaggggcugacggacccugcaaaguccccgcccaaauggccguagacaugcaaacgcucaccccagucggcagacuuauaaccgcgaaccccguaaucaccgaaagcaccgaaaacucaaaaaugaugcucgagcuagacccacccuucggcgacagcuacaucgucaucggcgugggagaaaagaagaucacacaccacuggcacagaagcggcucgacaauaggcaaagcauucgaagccaccguacguggcgcgaaacgcauggccgugcucggagacaccgcuugggacuucgggagcguagggggagcccucaacucccucggcaagggaauacaccaaauauucggcgcugccuucaagagccucuucggcggaaugaguugguucucccaaauacucaucggaacucuccuaauguggcucggacucaacaccaaaaacggcucgauuucccucaugugccuugcacuuggcgguguccuuauauuucucuccaccgccguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5151 - RNA, 2284 nt, Artificial Sequence
  KU922923.1 prME-short mRNA Design 1 opt
gggagaaagcuuaccaugaccagcgucggcauuguaggccuauuacuuacaacagcuauggccgccgaagucacaagacggggauccgccuacuacauguaccuagaccgcaacgacgccggagaagccauaucauuccccacaacccuaggcaugaacaagugcuacauacaaauaauggaccuuggucacaugugcgacgccacaaugagcuacgaaugucccaugcucgacgaaggcguagagcccgacgacgucgacugcuggugcaacacaacauccacguggguaguauacgggaccugccaccacaagaaaggcgaggccagacggucacgacgagccguaacccuacccucccacuccacccgaaaacuccaaacacgcagccaaacuuggcuagaaucacgagaauacaccaaacaccuaauccgcguagagaacuggauauucagaaacccaggauucgcacuagccgccgccgcaauagccuggcuccuaggcucaucgaccucacagaaaguaaucuaccucguaaugauacuucucaucgcacucgccuacagcauccgcugcaucggcguaagcaaucgcgacuucgucgagggaaugucaggaggaacaugggucgacgucgugcuagagcacggcgggugcguaacggucauggcacaagacaaacccaccgucgacaucgaacucguaacgaccacagucucuaacauggccgaaguacgaaguuacugcuacgaagccuccauaucggacauggcaagcgacucccgcugcccgacccaaggagaagccuaccuggacaaacagagcgacacacaauacgugugcaaacgaacucuagucgaccgcggauggggcaacggaugcggccucuucggaaaaggaagccuaguaacaugcgcgaaauucgcuugcuccaagaaaaugaccgggaaauccauccaaccugagaaccuggaauaucgaauaaugcuauccguacacggcucccaacacuccggcaugaucgucaacgacacuggacaugaaacagacgaaaaccgcgccaaaguggaaaucacacccaacuccccacgcgcggaagcaacgcucggaggauucggcucacuaggccuagacugcgaacccagaaccggacuagacuucagcgaccucuacuaccucacaaugaacaacaaacacuggcuaguccacaaagaaugguuccacgacaucccccuaccauggcacgcaggggcggacacgggaacaccccacuggaacaacaaagaagcucucguagaguucaaagacgcgcaugcgaaacgacaaaccguaguaguccucggaucgcaagaaggagcaguacacaccgcccuggccggcgcccuagaagccgaaauggacggagcaaaaggccgacucagcagcgggcaccucaaaugcagacuaaaaauggacaaacuaagacucaaaggcguaagcuacagccuuugcacagcagccuuuacauucacaaaaauucccgcugaaacacuccacggcaccguaaccguagaaguccaauacgcaggcaccgacggaccaugcaaagucccagcacagauggcugucgacaugcaaacacucacacccguaggacgacuaauaacugccaaccccgugaucaccgaaagcacagaaaacagcaagaugaugcucgaacuggacccacccuucggcgacuccuauaucgucauuggagucggagaaaagaaaaucacccaccacuggcaccgcagcggcuccacaaucggcaaggccuucgaagcaaccguaagaggcgccaaaagaauggccguacuaggagacacggcaugggacuucggcagcguaggcggggcacucaacagucuaggaaagggcauccaccaaauauucggcgcagccuucaaaucacuauucggcggcaugagcugguucagucaaauacucauaggcacgcugcuaauguggcucggccucaauaccaaaaacggaucgaucucccucaugugccucgcccuuggaggcgugcuaaucuuccuauccaccgcagucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5152 - RNA, 2284 nt, Artificial Sequence
  KY075937.1 prME-short mRNA Design 1 opt
gggagaaagcuuaccaugaccuccguaggaauagucggccuccuccugaccacagccauggccgccgaagugaccagacgcggcucagcauacuacauguaccucgacaggaacgacgccggcgaagccaucucauucccgaccacauuaggcaugaacaaaugcuacauccaaaucauggaucuaggccacaugugcgaugccaccaugucauacgaaugccccaugcucgaugaaggcgucgaaccggacgacguagacugcuggugcaacaccaccuccaccugggucguauacggaaccugccaccacaagaaaggugaagcacgcagaagccgacgcgccgugacacuucccucacacuccacccgaaaacuacaaacacgcucacaaaccuggcuagaaucccgcgaauacaccaaacaccucauacgcgucgaaaacuggaucuuucgaaacccaggauucgcucucgccgcagccgcaaucgcauggcuucucggaucuuccacaucccaaaaagucaucuacuuaguuaugauccuccucaucgccccagccuacuccauacgaugcaucggcguaagcaaccgcgacuucgucgaaggcaugucgggaggcacguggguagacgucguucuagaacacgguggcugcguaacaguaauggcccaagacaagcccaccgucgacauugaacucgucaccaccacuguaucaaacauggcugaaguccgcagcuacugcuacgaagcaagcaucuccgacauggucuccgacagccgcugcccaacccaaggcgaagcguaccuagacaaacagucggacacccaauacgucugcaaacgcacccuagucgacagagguuggggcaacggaugcggacucuucggcaagggaucccuaguaacaugugccaaauucgcgugcucgaagaaaaugaccggaaaaagcauccagcccgaaaaccucgaauaccgcauaaugcucuccguccacggaagccaacacuccggcaugaucgugaacgacaccggacacgaaaccgacgaaaaccgcgcuaaaguagaaaucacaccaaacucaccccgcgcagaagcaacccuaggaggcuucggaucccucggccuagacugugaaccccggaccggccuagauuucuccgaccucuacuaccuaaccaugaacaacaaacacuggcucguacauaaagagugguuucacgacaucccccuccccuggcacgcgggcgcagacacagguacaccccauuggaacaacaaagaagcccuugucgaguucaaagacgcacacgccaaaagacaaaccgucgucgugcuuggcucccaggaaggagccgugcacacagcccuggccggagcgcuagaagcagaaauggacggcgccaaaggaagacuaagcuccggacaccuaaaaugccgacuaaaaauggacaaacuucgacuuaaaggagugucauacucacucugcacggccgcauuuaccuucaccaaaauccccgcagaaacacuacacggcaccgucaccgucgaaguacaauacgccggaaccgacggcccaugcaagguaccagcacaaauggccgucgacaugcagacacuuaccccgguaggccgacugauaaccgcuaacccagucaucaccgaaucaaccgaaaauucgaaaaugaugcuggaacucgacccacccuucggagacucauauaucgucauaggcguaggagaaaagaaaaucacccaccacuggcaccgcucuggcagcacaauaggaaaagccuucgaagccacagucagaggcgccaaacgcauggccgugcucggcgacaccgccugggacuucggaagcgucggaggcgcccucaacagccugggcaaaggaauccaccaaauauucggagcagccuuuaaaucccuuuucggaggaaugucaugguucucccaaauucuaauuggcacacuccuaauguggcucggacuaaacaccaaaaauggcucaauaagccugaugugucuagcacuaggaggcguacucaucuuccuuagcaccgccgucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5153 - RNA, 2284 nt, Artificial Sequence
  KY003156.1 prME-short mRNA Design 1 opt
gggagaaagcuuaccaugaccuccguaggcauagucggccuacuccugacaaccgcaauggcagccgaagucacacgccgcggaagcgccuacuacauguaccucgaccgaaaugacgccggcgaagccaucagcuuccccaccacgcucggcaugaacaaaugcuacauacaaaucauggaccucggccacaugugcgacgccaccaugucguacgaaugccccaugcuagacgaaggcgucgaaccagacgacguagacugcuggugcaacaccacaucgacauggguaguguacggaacaugccaccauaagaaaggagaagcaagacgcagcaggcgagcggucacccuacccagccacuccacgagaaaacuccagacacgcucccaaacauggcucgaaagcagagaauacacuaaacaccucauccgaguagaaaauuggauauuuagaaacccaggcuucgcgcuagcggcagccgcaaucgccuggcuacucgguaguuccacaucacaaaaaguaaucuaccucguaaugauccuccuaauugcaccagcauacuccauaagaugcaucggcaucuccaacagagacuucguggaaggcaugucagggggaacauggguagacguuguacucgagcacggcggcugcguaaccguaauggcccaagacaaaccaacaguggacaucgaacucguuaccacaaccgucaguaacauggccgaaguccguuccuacugcuacgaggccaguauauccgacauggccagcgacagccgcugcccaacccaaggggaagccuaccucgacaaacaaucagacacccaauauguuugcaaaagaacccuagucgaccgaggcuggggaaacggaugcggacuuuucggcaaaggcucgcucgucacaugcgccaaauucgcaugcuccaagaaaaugaccggcaaaagcauacaaccagaaaaccucgaauaccgcaucaugcucuccguacacgguagccaacacagcgggaugaucgucaacgacacaggccacgaaaccgacgaaaaccgcgcgaaagucgaaauaaccccuaacucaccccgugccgaagcaacacuuggcggguucgguauccugggccucgacugcgaacccagaaccggccucgacuucuccgaccucuacuaccuuaccaugaauaacaaacacuggcuaguccacaaagaaugguuccacgacauaccgcuccccuggcacgccggagccgacacaggcacaccccacuggaacaacaaagaagcccugguagaguucaaggacgcgcacgcaaaacgacagaccguagucgugcucggcagucaagaaggugcugugcacacggcacucgccggugcacuggaagcagaaauggacggagcaaaaggccgccuauccagcggccaucucaaaugccgacucaaaauggacaaacuacgucuaaaaggagugucguacagccuaugcacagccgccuucacauucacgaaaaucccagccgaaacacuacacggaacgguaacaguagaaguacaauaugcaggcaccgacggaccaugcaaaguacccgcccaaauggccguugacaugcaaacucuaacuccaguaggacgccugauuaccgccaacccagucaucaccgaaagcaccgaaaacucuaaaaugaugcucgaacuggacccaccauucggugacagcuacaucgucauaggcguaggagaaaagaaaaucacccaccacuggcaccgcagcggcuccaccauaggcaaagcauucgaagcaaccguccggggagccaaacgcauggcaguccucggcgacaccgccugggauuucggguccgucggcggggcccucaauucccuggggaaaggaauacaccaaaucuucggggccgccuucaaaagccuuuucggcggaaugucaugguucucucaaauacucaucggaacccuacuaauguggcuuggccugaacaccaaaaacggaagcaucucacucaugugccucgcacuuggaggcgugcucaucuuccuauccaccgcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5154 - RNA, 2284 nt, Artificial Sequence
  KU312313.1 prME-short mRNA Design 1 opt
gggagaaagcuuaccaugacaagcguaggcaucguaggacuccuccuaacaaccgccauggcagcagaaguuacacgccggggaucagcauacuacauguaccuagaccgcaacgacgccggugaagccaucucguuccccacaacacugggcaugaacaaaugcuacauccaaaucauggaccucggacauaccugcgacgcaacaaugucauaugaaugccccaugcuagacgaaggcgucgaacccgacgacguagacugcuggugcaacaccaccagcacguggguagucuauggcaccugucaccacaagaaaggcgaagcacgccguucucgcagagcagucacccuacccucacacagcauccgcaaacuucaaacccgcucccaaacauggcucgagucccgggaauauacgaaacaccucauacgaguagaaaacuggaucuuccgcaaccccggcuuugcccuagccgcagcagcaauagccuggcuauuaggcuccagcaccagccaaaaaguaaucuaccuggucaugauccuccucauugccccugcauacucaauacgcugcaucggagucucaaacagggauuucgucgagggaaugucgggcggaacgugggucgacgucguccucgaacacgguggcugcgugacagucauggcccaagacaaaccgacaguugacauagaacuugucaccacaacaguaucaaacauggcggaaguccgcagcuacugcuacgaagccucaauauccgacauggcaagcgacagccgaugcccaacccaaggcgaagcauaccucgacaaacaauccgacacgcaauauguaugcaaacgcacccuaguagaccggggcuggggaaacggcugcggacucuucggcaaaggcagccuagucacaugcgcuaaauucgccuguagcaagaaaaugacaggcaaaagcauccaacccgaaaaucucgaguaccgaaucaugcuaagcguacacggcucacaacacucaggaaugauagucaacgacacaggacacgagacagacgaaaaccgcgcaaaagucgagauaacgcccaacuccccacgcgcagaagcaacacucggcggcuucggaagucucggucuagacugcgaaccccgaacaggacuagacuucucagaccuauacuaccugacuaugaacaacaagcacuggcucguccacaaagaaugguuucacgacauccccuuaccauggcacgcaggcgcugacaccggcacaccacacuggaacaacaaagaagcacucgucgaguucaaagacgcucacgccaaacggcaaaccgucguuguccugggcucccaagaaggcgcgguacacaccgcccucgccggcgcucucgaggcagaaauggacggagcaaaaggacgccucuccaguggacaccucaaaugcagacuaaaaauggacaaacuacgccucaaaggugucucauacagccucuguacagcagcauucaccuucaccaaaaucccggccgagacacuccacggaaccguaaccguagaaguccaauacgcagggacagacggacccugcaaagucccagcacaaauggcaguagacaugcaaacacuaacacccgugggaagacucaucaccgcaaaccccgucaucaccgaaagcaccgaaaacagcaaaaugaugcuagaacuagacccacccuucggcgacucauacauaguaauaggcgugggagaaaagaaaaucacccaccacuggcaccgcagcggaucaaccauaggcaaagcauucgaagccacaguccgcggugcaaaacgcauggccguccucggcgacacagccugggacuucggcagcguaggcggcgcccuaaacucgcuaggaaaaggcauacaccagaucuucggggcagccuucaagagucucuucggcgguauguccugguucagccaaauccucaucgggacccuacucauguggcucggccucaacgccaaaaacggcucgaucucacucaugugccuagcacucggcggcguccucauauuccugucaacagccguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5155 - RNA, 2284 nt, Artificial Sequence
  KY075935.1 prME-short mRNA Design 1 opt
gggagaaagcuuaccaugacaucagucgggauagucggccuacuacuaaccacggccauggcagccgaaguaacccgacgcggaucggcauacuacauguaccuagacagaaacgacgcaggagaagccauaucuuuccccaccacauuaggcaugaacaaaugcuacauccaaaucauggaccuaggacacaugugcgacgcaacgaugucguaugagugccccaugcucgacgaagggguggaacccgacgacguagacugcuggugcaacacaaccucaaccugggucguauacggaaccugccaucauaagaaaggggaagcccaacgcucccgcagagccguaacacuacccagccacagcaccagaaaacuacaaacccgcucacaaaccuggcuggaaucacgcgaguacaccaaacaccuaauaaggguagaaaacuggauauuccggaacccaggcuucgcccucgccgcagcagcaauagcauggcuacucggauccucaacaucccagaaagugaucuaccucguuaugauacuccuuaucgcccccgccuacagcauccgaugcauaggcgucagcaaccgagacuucguagaaggaaugagcggcggcaccuggguagacgucguacucgagcacggcgguugugucaccgucauggcccaggacaaaccaacaguagacauugaacucgugacaacaacggucuccaacauggcagaaguacgcagcuacugcuacgaagccagcaucagcgacauggccuccgacagccgcugccccacacaaggagaagcguaccuggacaaacaaucagacacccaauacgucugcaaacgcacccuagucgaccgaggauggggcaacggaugcggccucuucggcaaaggaucgcucguaacaugcgccaaauucgccugcagcaagaaaaugaccggaaaaucaauccaacccgaaaacuuagaauaccgcauaaugcuaucaguccacggcucacaacacagcggcaugaucguaaacgacaccggccacgaaaccgaugagaaccgcgcaaaggucgaaauaacccccaacagcccccgcgccgaagcaacccuaggaggauuuggaagccucggccuagacugcgaaccacgcaccggccucgacuucuccgaccuauacuaccucaccaugaacaacaagcacuggcugguccacaaagaaugguuccacgacaucccccuccccuggcacgccggagccgacacgggaacaccccacuggaauaacaaagaggcccuaguagaguucaaagacgcacacgcgaaacggcaaacaguaguuguacucggaucacaagaaggggccguacacacagcccuagcaggagcacucgaagcggaaauggacggagccaaaggcagacucagcagcgggcaucuaaaaugccgacucaaaauggacaaacuccgauugaaaggcgucagcuacagccucuguaccgcagcauuuacauucaccaagauacccgccgaaacacuacacggaacaguaaccguagaaguccaauacgccgggacagacgggcccugcaagguacccgcacagauggcaguggacaugcaaaccuuaacaccgguaggacgacugaucacagcgaacccagucaucacggaaucaaccgaaaacuccaaaaugaugcuggaacuagacccgccuuucggcgauagcuacaucguaauuggagugggcgaaaagaaaaucacacaccacuggcaccgcuccggcucaacaaucggaaaagccuucgaagccaccguccgcggcgccaaaagaauggcaguccuaggagacacagcaugggacuucgguagcguaggcggagccuuaaacucacugggaaaaggcauccaccaaaucuucggagccgcauucaaaucacuauucggaggaauguccugguucagucaaauacucaucggcacgcuacucauguggcuaggacucaacaccaaaaacggaagcaucucgcugaugugccuagcccuaggaggcguacucauauuccuauccacagcggucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5156 - RNA, 2284 nt, Artificial Sequence
  KY014320.1 prME-short mRNA Design 1 opt
gggagaaagcuuaccaugacaagcgucggaauagugggacuccuacucacaacagcaauggcggccgaggucacacgacgaggaagcgccuacuacauguaccuagaccgcaacgacgcaggagaggccaucucguuccccacgacccuaggcaugaacaaaugcuacauccagaucauggaccucggucacaugugcgacgcaacaaugucguacgaaugccccaugcucgacgaaggggucgaaccagacgacguagacugcuggugcaacacaacaagcaccugggugguauacggcaccugucaccacaagaaaggagaagcccgaagaagccgcagagccguaacacucccaagccacuccacccggaagcuacaggcacgcagccaaaccuggcuagaaagcagagaauacaccaaacaccucauacgcgucgaaaacuggauauucagaaaccccggauucgcccuagccgccgccgccaucgcguggcuuuuagguuccuccacuagccaaaaaguaauauaccuaguaaugauacuccuaauagcgccagccuacagcaucagaugcauaggcguauccaacagagacuucgucgaaggcauguccggaggaacaugggucgaugucguacuagaacacggcggcugcguaaccgucauggcccaagacaaaccaacaguagauauagaacucgucacuaccacgguaagcaacauggccgaggugcgcucauacugcuacgaggccagcaucucagacauggcaucagacucacgcugcccaacacaaggagaagcauacuuagacaaacaaagcgacacacaauacguaugcaaacgcacccuaguagauagaggcuggggcaacgggugcggacucuucggcaaaggaucccuagucacaugcgcgaaauucgccugcucaaagaaaaugacaggaaaaucaauacaaccagaaaaccucgaauaccgcaucaugcuaagcgugcacggaucacaacacuccggcaugaucguaaacgacacaggccacgaaacagacgaaaaccgagcaaaaguggaaauaacaccuaacucaccacgcgccgaagccacccuagggggcuucggcucacucggccucgacugcgaacccaggacaggccuggacuuuucggaccuguacuaccuuacaaugaacaacaaacacuggcuaguacauaaagaaugguuccacgacauuccacuucccuggcacgcaggagccgacaccggcaccccacacuggaacaauaaggaagcacucguagaguucaaagacgcccacgccaagagacagacaguagucguacucggaucccaggagggcgcaguacacacggcccuagcgggcgcacuagaagccgagauggacggcgccaaaggccggcucagcagcggccaccucaaaugccggcuuaaaauggacaagcucagacugaaaggcguaucauacagccuaugcaccgccgccuucacguucacaaaaaucccagcggaaacacuacacggaaccgucacagucgaagugcaauacgcgggcacagacggccccugcaaagugcccgcccaaauggcggucgacaugcaaacacuaaccccaguaggaagacucaucaccgcaaacccggucauaacagaaagcacagaaaacagcaagaugaugcuagaacuagacccaccauucggcgacucauacauagucaucggcguaggagaaaagaaaaucacacaccacuggcaccgaagcggcucuacaaucggaaaagccuucgaagccaccguacgcggcgcgaaacgcauggccguccucggagacacagcaugggacuuuggcagcguaggaggcgcccucaacucccuaggcaaaggcauccaccaaauauucggggccgccuucaaaucccucuucggaggaaugucaugguucagccagaucuuaauaggaacccugcuaauguggcuaggccucaacacgaaaaacggguccauaucgcuaaugugccuagcacugggcggaguccucauauuccuaucaacagccguauccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5157 - RNA, 2284 nt, Artificial Sequence
  KY328290.1 prME-short mRNA Design 1 opt
gggagaaagcuuaccaugacaagcgucggcaucguaggccuccuccugaccacagccauggcagccgaaguuacacgccgaggaucagcauacuacauguaccucgaccgcuccgacgcgggagaagccaucagcuucccuaccacccucggcaugaacaaaugcuacauacaaauaauggaccugggacacaugugcgacgcaacaaugucguacgaaugcccaaugcuagacgaaggcgucgaacccgaugacguagacugcuggugcaacaccacauccaccuggguggucuacggaaccugccaccacaaaaagggcgaggccagacggucgagacgcgcggucacccuuccuagccacagcaccagaaaacuacaaacacggucgcagacuuggcucgaaaguagagaguauaccaaacaccucauccgggucgaaaauuggaucuuccgcaaccccggauucgcgcucgccgccgccgcaauagcguggcuacucggcagcuccacaagccaaaaagucauauaccucguuaugauacuccucaucgcccccgccuacuccauucgaugcauaggcguaagcaacagagacuucguagaaggcaugaguggagggaccugggucgacguaguccucgaacacggcggcugcgucaccguaauggcgcaagacaaacccacaguagacaucgagcuagucaccaccaccguaaguaacauggcagaaguccgauccuacugcuacgaagcaucaaucuccgacauggccuccgauagccggugccccacacaaggcgaagcauaccucgacaagcaaagcgacacucaguacgucugcaaaagaacacucgucgaccgaggcuggggaaauggaugcggccuauucgguaaaggcucccucguaaccugcgccaaauucgcauguucgaagaaaaugaccggaaaaagcauacaacccgagaaccuagaauaccguauaaugcuaagcguccacggaagccaacacagcggaaugaucgucaacgacacaggccaugaaacagacgaaaaccgcgccaaaguagaaauaaccccuaacucaccaagggcagaagcaacccuaggcggauucggaagccuaggacucgacugugaaccaaggacaggacucgacuucucagaccuauacuaccucaccaugaacaacaaacacuggcugguccacaaagaaugguuccacgacauuccgcuaccguggcaugcuggcgccgauacaggcacgccccauuggaacaacaaagaagcacucguagaguucaaagacgcccacgcaaaacgccaaaccgucgugguccuagggagccaggaaggagccguccacaccgcccucgccggagcccucgaagccgaaauggacggcgcaaaaggccgcuuaagcuccggccaccuaaaaugccgccugaaaauggacaaacucaggcucaaaggcguaagcuacucgcuauguaccgcagcauucacauucagcaaaaucccagcagaaacacuacacggcacagucacagaagaaguacaguacgccggcaccgacggccccugcaaaguccccgcgcaaauggccgucgauaugcaaacacuaacacccguaggccgacuaauaacagcaaaccccguaaucaccgaaagcaccgaaaacagcaaaaugaugcuggaacucgacccgcccuucggagacucauacaucguaauaggcgucggagaaaagaaaaucacucaccacuggcaccgcuccggcagcaccaucggcaaagccuucgaagccaccguccgcggcgccaagcgaauggcgguacuaggcgacacagccugggacuucggaucaguuggaggagcccuaaacucacuaggcaagggcauacaccaaaucuucggagcagccuucaaaucccuauucgggggcaugagcugguucagccaaauccuaaucggaacccuccucauguggcucggccuaaacaccaaaaacggcuccauuagucuaaugugccuagcccucggcggcgugcucaucuuccuauccacagcgguaucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5158 - RNA, 2284 nt, Artificial Sequence
  KU681081.3 prME-short mRNA Design 1 opt
gggagaaagcuuaccaugaccucagucggaauaguaggacuacuccucacgacagcaauggccgcagaaguaaccagacgcgguuccgccuacuacauguaccucgaccgcuccgacgccggagaagccaucagcuuccccacaacccuaggcaugaacaaaugcuacauacaaaucauggaucucggacacaugugcgacgccaccauguccuacgaaugccccaugcucgacgaaggaguagagccggacgacguugacugcuggugcaacacaacauccacguggguagucuacggaaccugccaucacaagaaaggcgaagcccgaagaucccgccgcgccgucacacuacccagccacucaacgcggaaacuccaaacaagaucgcaaaccuggcuagaaagcagagaauauaccaaacaccuaaucagaguagagaacuggauauucaggaacccaggcuucgcacuagccgccgcagccauagccuggcuccucgguuccuccacaagccaaaaaguaauauaccucgucaugauacuccucaucgcaccagcauauucgauacguugcauaggagugagcaauagagacuucguagagggaaugucaggaggcaccuggguagacgucguacucgagcacggcggauguguaacaguuauggcccaagacaaacccaccgucgacauagaacucgucacaaccacagucucaaacauggccgaaguaagauccuacugcuacgaggcuuccaucucagacauggcauccgacucacgcugcccaacccaaggcgaagcguaucucgacaaacagucugacacccaguacgucugcaaacgcacacucguggacagaggauggggcaacggaugcggccucuucggcaaaggcucccuaguaacaugcgccaaauucgcaugcuccaagaaaaugaccggaaaaagcauacagcccgaaaaccucgaauaccgcauaaugcuaucaguccacggaucccaacacuccggcaugaucguaaacgacaccggccacgaaaccgacgaaaaccgcgcgaaagucgaaaucacccccaacagcccacgagccgaagccacacuagguggcuucggaagccucggacuggacugugaaccccgcacaggccuagacuucagcgaccuuuacuaccucaccaugaacaacaaacacuggcucguacacaaagaaugguuccacgacauaccacuaccguggcacacaggagcagacaccggaacaccacacuggaacaacaaagaagccuuaguagaguucaaagacgcccacgcaaaacgacaaacagucguaguacucggcucucaagaaggagccguccacaccgcacuagcaggcgcccucgaagccgaaauggacggagcuaaaggcaggcugagcucgggccaccuuaaaugcagacucaaaauggacaaacuuagacucaaaggaguaucauauucccucugcacagcagcauucaccuuuaccaaaauaccagccgaaacccuacacggaaccgugaccguagaaguucaauacgcaggaaccgacggcccaugcaaaguacccgcacaaauggcaguggacaugcagacccugacaccggucggacgccucauaacagccaaccccgucaucacugaaggcacagaaaacucgaaaaugaugcucgaacuagacccacccuucggcgacuccuacauagucaucggcgucggugaaaagaaaaucacacaccacuggcacagaagcggcucaacaaucggaaaagccuucgaagccaccguccgcggugcgaaaagaauggcaguccucggcgacacagcaugggauuucggaagcguaggcggaguacuaaacucgcucggcaaaggcauacaccaaaucuuuggcgcagccuucaaaagccuauucggaggcauguccugguucagccagauccuaaucggcacacuccuaauguggcugggacucaauaccaaaaacgggagcauaucccucaugugccuugcacuaggcggcguucucaucuuccucuccacagccgucagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5159 - RNA, 2284 nt, Artificial Sequence
  KX827309.1 prME-short mRNA Design 1 opt
gggagaaagcuuaccaugaccagcgucgguauagucggcuuacuccucacaacagcaauggcagccgaggucacccgaagaggaucagccuacuacauguaucuggaccgaucagacgcaggggaagcaaucuccuucccaacaacccuaggcaugaauaagugcuacauacaaauaauggaccucggacacaugugcgacgccacgauguccuacgaaugcccaaugcuugacgagggcguagaaccagacgacgucgacuguuggugcaacaccacguccacgugggucgucuacggaaccugccaccauaagaaaggcgaagcgcgacguagcagacgagcagucacucuaccaagccacagcaccagaaaacuacaaacaagaagccaaaccuggcuagaaagccgagaguacaccaaacaccuaauccgcguagaaaacuggaucuucaggaacccuggcuucgcacucgccgcagcagcaaucgccuggcugcucggaucaagcacaagccaaaaaguaauauaccuugugaugauccugcuaauagcccccgccuacuccauacgcugcauaggagucucaaaucgcgacuucguugaaggcauguccggcggcacaugggucgacguagugcucgaacacgguggcugcgucacagucauggcccaggacaaaccaacaguagacauagaacuuguaaccacuaccgucaguaacauggccgagguacguucauacuguuaugaagcauccauaucggacauggccucagacucccgaugcccaacccaaggcgaagcguaccucgacaaacaaucagacacacaauaugucugcaaacgcacccuagucgacagaggcuggggaaacggaugcggacucuucggaaaaggcucccucguaaccugcgcaaaauucgcgugcucaaagaaaaugacgggcaaaagcauacaacccgaaaaccucgaguaccgcaucaugcuaucaguccacgguucacagcauagcggcaugauaguaaacgacacaggacacgagacagacgagaaccgcgcaaaagucgagauuacaccuaauaguccccgcgcagaagccacauuaggcggauucggaagccugggacuagacugcgaaccucgaaccggacucgacuucuccgaccucuacuaccucaccaugaacaacaaacacuggcugguccacaaagaaugguuccacgacauccccuuaccauggcacgccggcgcggacacaggcaccccacacuggaacaacaaagaagcccuagucgaguucaaagacgcccacgccaaaagacaaacuguagucguccuaggaagccaagaaggagcagugcacaccgcacuggcaggcgcccuagaagcagaaauggacggcgccaaaggcagacugagcucaggccaccuaaaaugccgacucaaaauggauaaacuccgauuaaaaggggucucauacucccucugcaccgccgccuucacuuucacaaaaauccccgccgaaacccuccacgguaccgucaccgucgaaguacaauacgccggcaccgacggccccugcaaaguccccgcccaaauggccguagacaugcaaaccuuaaccccagucggacgccucaucacagcaaaucccgucaucaccgaauccaccgaaaacucgaaaaugaugcucgaacuagacccaccauucggagacagcuacaucgucaucggaguaggugaaaagaaaauaacccaccacuggcaccgcagcggaagcaccauaggaaaagccuucgaggccaccguccgaggagcaaaaagaauggcgguucucggugacaccgcaugggacuucggcagcguaggcggagcucugaacagccuaggaaaaggaauccaccaaauuuucggggccgcauucaaaagccucuucggaggaauguccugguucucgcaaauacucauuggcacacuccucauguggcucggacucaacacaaagaacggcagcaucagccucaugugccucgcccuugguggcguccucauauuccucagcacagccgucucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5160 - RNA, 2284 nt, Artificial Sequence
  KU955593.1 prME-short mRNA Design 1 opt
gggagaaagcuuaccaugaccagcgugggcauagucggacuccuacucaccaccgccauggccgucgaagucacgcgccggggcaacgccuacuacauguaccuagaccguagcgacgcaggagaggcaauaucauuccccacaacaaugggaaugaacaaaugcuacauccagaucauggaccuaggccacaugugcgacgcaacaaugucauacgaaugcccaaugcucgacgaaggaguggaacccgacgacguagacugcuggugcaacacaacaagcaccuggguaguauacggaacgugccaccacaagaaaggcgaagcccgacggucccggcgagccgucacccucccaagccacuccacacgaaaauuacaaacaaggagccaaaccuggcucgaaagccgagaguacaccaaacaccucaucagaguggaaaacuggaucuuccgaaacccuggauucgcgcucgccgcagcagccauagcauggcuucucggcuccaguaccagccagaaaguuaucuaccucguaaugauccuacucaucgcuccagcauacuccauccgaugcaucggcgucagcaaccgcgauuucgucgaagguaugagcggcggcacauggguagacgucguacuagaacacggcggcugugugacagucauggcucaggacaaaccaacagucgauaucgaacucguaaccacaaccgucuccaauauggcagaagucagaucauauugcuacgaagcaagcaucuccgacauggccagcgacucacguugcccaacccaaggcgaagccuaccuggacaaacaguccgacacccaauacguaugcaaacgaacccucguugaccgaggcuggggcaacggcugcggccucuucggcaaaggaucacucguaacaugcgccaaauucgcuugcucaaagaaaaugacgggaaaaagcauacaacccgaaaaccuagaguaccguauaaugcucuccguccauggaucccaacacucaggcaugaucgucaacgacacgggccacgaaacagacgaaaaccgcgcaaaagucgaaauaacacccaacagcccccgagccgaagcaacacucggaggcuucgguagccucggccuagacugugaaccgcgcacaggacuagacuuuagcgaccucuacuacuuaaccaugaacaacaaacacuggcucguccacaaagaaugguuccacgacauaccauugcccuggcacgcaggggccgacacaggcaccccacacuggaacaacaaagaagcccucguagaguucaaagaugcacacgcuaaaagacaaaccgucgucguacucggcagccaagaaggcgccguacacacagcccuugcgggcgcacuagaagcagaaauggacggagccaaaggccgacugucauccggccaccucaagugcagacucaaaauggacaaacuccgccuaaaaggcguuuccuacagccucugcaccgccgccuucacauucaccaagauucccgcggaaacucuccaugggaccgucacaguagaaguacaauacgcaggaacagacggccccugcaaaguccccgcccagauggccgucgacaugcaaacccugacccccgucgggcgucuaaucacagccaacccgguaaucaccgaaucgaccgaaaacucaaaaaugaugcuagaacuugacccgcccuucggcgacuccuacaucgucauaggcguaggcgaaaagaaaauaacccaucacuggcaccgauccgguagcaccauagggaaagccuucgaagccaccguacgcggagcaaaaagaauggccguccucggagacacagcaugggacuucggaucgguaggcggagcacucaauucacuaggcaaaggcauacaccagaucuucggcgcagcauucaaaagccucuucggcggaaugagcugguucagccaaauccuaauaggaacccuacugguuuggcuaggccucaacaccaaaaacggcucaaucagccucaugugccuugcccuaggaggcguccucauauuucuaucaacugcagucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5161 - RNA, 2284 nt, Artificial Sequence
  KY272987.1 prME-short mRNA Design 1 opt
gggagaaagcuuaccaugaccuccguaggcauagucggacuccucuugaccacagccauggcagccgaagucacccgacgcggcagcgcauacuacauguaccuagaccguuccgacgcaggcgaagcaauuagcuuccccaccacccuaggcaugaacaaaugcuacauacaaauaauggaucucgggcacaugugcgaugccacaaugucguacgaaugccccaugcucgacgaaggaguagaacccgacgacgucgacugcuggugcaacacaaccaguacauggguagucuacggaaccugccaccacaagaaaggugaagcucggagaucccgacgcgcggucacccuccccucccacuccacaagaaaacugcaaacaaggucacaaacauggcucgaaagcagagaauacaccaagcaccuaauaagaguggaaaacuggauauuucggaaccccggcuucgcguuagccgcagccgccaucgcguggcuccuagggagcucaacuucacaaaaaguaauauaccucgucaugauccuccugauagccccagccuacuccauacguugcauaggcguaucuaaccgcgacuucgucgaaggaauguccggaggcacaugggucgacgugguacucgaacauggcggcugcguaaccguaauggcacaagacaaaccgacgguagacauagaacugguuacaaccaccgucagcaacauggccgaaguaagaucauacuguuacgaagcaucaaucagcgacauggccagcgacucccgcugccccacccaaggagaagcguaucucgacaagcaauccgacacccaauauguaugcaaacgcacccucguggaccgaggauggggcaacggaugcggccuauucggcaaaggaucccuagucacaugcgcgaaguucgcaugcucaaagaaaaugaccggaaaauccauacaacccgagaaucucgaauacagaaucaugcucuccguacacgggucucaacauuccggcaugaucgugaacgacacuggccacgaaaccgaugaaaaccgagcaaaagucgagauaacaccaaauucaccccgcgccgaagccacccuaggaggcuucggaagccuaggccucgacugcgaaccccgaaccggacuggacuucuccgaccuguacuaccucacaaugaacaacaaacacuggcuaguccacaaagagugguuccacgacauaccacuucccuggcacgccggcgccgauacagggacaccccacuggaacaacaaagaagcccuuguagaguucaaagacgcacacgcaaaacgccaaacagucgugguccuaggcagccaagagggagccguacacaccgcccuagccggagcccuagaagccgaaauggacggcgccaaaggcagauuaagcuccggccaccucaagugccgacuaaaaauggauaaacugcgccuuaaaggcguaagcuacucccucuguacagcagcauucacauucacaaaaauacccgccgagacacuccacggaacaguaacagucgaaguccaauacgcaggaacagauggacccugcaaagucccggcacaaauggccguagacaugcaaacccuaacccccgucggcagacucauaaccgcaaaccccgucauaacagagucaaccgaaaacucaaaaaugaugcuggaacucgacccacccuucggcgacagcuacauaguaauaggcguaggcgaaaagaaaauaacacaccacuggcaccgcagcggaucaaccaucgggaaagccuucgaagccacgguccgaggcgcaaaaagaauggccgugcucggcgacacagccugggacuucggcagcgucggcggagcccucaacucccuaggcaagggcauucaccaaaucuucggagccgccuucaaaagccucuucggaggcaugucgugguucucccaaauacuaaucggcacccuccuuauguggcugggccucaacaccaaaaacggcuccaucucgcuagucugccuagcccucgggggaguccucauauuccuuucgacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5162 - RNA, 2284 nt, Artificial Sequence
  KY007221.1 prME-short mRNA Design 1 opt
gggagaaagcuuaccaugaccucaguuggaauaguggggcuacuacuaaccacagccauggcggcagaaguaacccgaagaggcagcgccuacuacauguaccucgaccgcagcgacgccggcgaagcaaucagcuucccaaccacccuaggaaugaacaaaugcuacauccaaaucauggaccuaggucacaugugcgacgccaccaugagcuacgaaugccccaugcuugacgaaggaguugaaccagacgacgucgacugcuggugcaacaccacaagcaccugggucgucuacgggaccugccaccacaagaaaggcgaagcgcgccgaagccgcagagcugucacccuccccagccacuccacccgaaaacuacaaaccaggagccaaacauggcucgaaagccgcgaauauaccaaacacuuaaucagaguggagaacuggauauuccgcaaccccggauucgcacucgcagcggcagcgaucgcauggcuccuaggcagcuccaccagccaaaaagucaucuacuuagucaugauccuccucauagcccccgccuacucgaucagaugcaucggcguuaacaaccgagacuucgucgaaggcaugucuggcggcaccuggguugacgucguccuagagcacggcggcugcguaaccguaauggcucaagacaaacccaccgucgacaucgagcuagucacaaccaccguaagcaacauggccgaaguucgaagcuacugcuacgaagcauccauuagcgacauggcaucagacucaaggugcccaacacaaggagaggcuuacuuagacaaacaaagcgacacgcaauacgugugcaaacgcacccuagucgaccgcggauggggcaacggcugcggccucuucgguaagggcagccugguaaccugcgcaaaauucgccugcucaaagaaaaugacaggaaaaagcauacagcccgaaaaucucgaauaccguauaaugcuaagcguccacggaucacaacacagcggaaugaucgucaacgacaccggacacgaaacagaugaaaaccgagccaaagucgaaaucaccccaaacagcccccgcgcugaagccacccugggcggguucggaucacuaggccuagacugcgagccgcgcacaggccuggacuucagcgaccucuacuaccuaaccaugaacaacaaacacuggcucguacacaaagaaugguuccacgacaucccacucccauggcacgccggcgcagacaccggaaccccgcacuggaacaacaaagaagcacucgucgaguucaaagacgcccacgccaaacgccagacagucgucguccugggaucccaagaaggcgccguccacacagcacucgccggcgcccuagaggccgaaauggacggagcaaaaggacgccuaucaaguggccaucucaaaugccggcuuaaaauggacaaacuuagauugaaaggcgucuccuacucucucuguaccgcggccuucacauucacaaaaauacccgcggaaacacuccacggcacagucaccgucgagguccaguacgcagggaccgaugggccgugcaaaguaccagcccaaauggccguagacaugcaaacacuaacccccgucggacgucuaauaacagccaaccccgucauaacggaaucaacagagaacuccaaaaugauguuagaauuagacccuccauucggcgacucguacaucgucauagggguaggagaaaagaaaaucacacaccacuggcaccgcagcggaagcaccauaggcaaagcguucgaagccaccguacgaggcgccaaacgcauggccguccucggagauaccgccugggacuucggaagcgucggcggagcccucaacucucuaggaaaaggcauccaccaaauauucggagccgcauucaaaagccuauucggaggcaugucaugguucucccaaauacucaucggaacgcucuuaauguggcuaggccucaauaccaaaaacggcuccauaucccuagucugcuuagcccucggcggcguccuaauauuccuaagcaccgcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5163 - RNA, 2284 nt, Artificial Sequence
  EU545988.1 prME-short mRNA Design 1 opt
gggagaaagcuuaccaugacaucaguagggaucgucggucugcuccugaccacagcaauggcaguggaagucacacgacgcggcagcgcguacuacauguaccucgaccgaucagacgcaggcgaagcaaucuccuuccccaccacacucggcaugaacaaaugcuacauccaaaucauggaccuaggacacaugugcgacgcaacaaugucauacgaaugcccaaugcuggacgaaggaguagaacccgacgacgucgacugcuggugcaacacuaccagcacaugggucguauacgggacuugccaucacaagaaaggggaagcaagacgcucacgacgagcggucacgcucccgagccacucaacacggaaacuccaaacucggucgcaaaccuggcuagaaucaagagaguacacaaaacaccuaauacgaguagaaaacuggaucuucagaaacccaggcuucgcccucgccgcggccgccaucgccuggcuccuaggcagcagcaccucccaaaaagucauauaccugguaaugauccuacugauagcaccagccuacucaaucaggugcauaggaguaagcaaccgagauuucguagaaggaauguccggaggcacauggguagacgugguccuggaacacggcggaugcgugacagucauggcccaagacaaaccagccgucgauauagaacucgucaccacaaccguaagcaacauggcagaaguaagauccuacugcuacgaagccagcauaagugacauggcaagcgacagccgcugccccacccaaggcgaagccuaccucgacaaacaaucagacacccaguacguaugcaaacgcacauuaguagacagaggcuggggcaacggcugcggacuauucgggaaaggcucgcugguaaccugcgccaaauucgcgugcuccaagaaaaugaccggcaaaagcauacagcccgaaaaccucgaauaccggauaauguuguccgugcacggcagccaacacuccggcaugaucgucaacgacaccggacaugagacagacgaaaaccgcgccaaaguagaaauaaccccuaacagcccgcgagccgaggcgacccucggagguuucggcucguuaggccucgauugcgaaccccguaccggacuagacuucuccgacuuauacuaccucacgaugaacaacaaacacuggcuuguacacaaagaaugguuccacgacauaccacugcccuggcacgccggcgcagacacaggcaccccacacuggaacaacaaagaggcccuaguagaauuuaaagacgcccaugcaaaacgccaaacaguaguaguccucggcagccaagaaggcgcagugcacacagcacuagccggagcccuagaggccgaaauggacggcgcaaaagggcgacuaaguagcggacaccuaaaaugccggcucaaaauggacaaacuccgccucaaaggcgucuccuacucccuaugcaccgcagcauuuacauucacaaaaauccccgcagaaacccuacauggaaccgugacaguagaaguccaauacgcaggaacggacgggccaugcaaagugcccgcacaaauggcaguagacaugcaaacacucacaccagucggcagacuaaucaccgcgaaucccgugauaaccgaaucaaccgaaaacagcaaaaugaugcuagaacuagacccacccuucggcgacaguuacauagucauaggcguaggagaaaagaaaaucacacaccacuggcaccgauccggaucaacaauaggaaaagcguucgaagcgaccguacgcggagccaaacgaauggcaguucucggagacacagccugggacuucggaagcguaggcggcgcgcuaaacagccucggcaaaggcauccaucagaucuucggagcagcguucaaaucacuauucggagggaugagcugguucagucagauacuaauaggcacauuguuaguguggcucggccuaaacacgaaaaacggcagcaucagcuuaaccugccucgcacucggcggcguacucauuuuucuaagcaccgcaguaucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5164 - RNA, 2284 nt, Artificial Sequence
  KU681082.3 prME-short mRNA Design 1 opt
gggagaaagcuuaccaugacaucagucggcaucguaggccuccuucuaacaaccgcaauggccguagagguaacgcgucgaggcucagcguacuacauguaccuggaccgaucagacgcgggggaggcgauaucguucccaaccacgcucggaaugaacaaaugcuacauacaaauaauggacuuaggacacaugugcgacgccaccauguccuacgaaugccccaugcucgacgaaggaguggaaccagacgacgucgacugcuggugcaacacaaccaguaccuggguagucuacggcacgugccaccacaagaaaggcgaagcccgccgcucccgccgagcugucacacucccaagccauagcacacgcaaacugcagaccagaagccaaaccuggcucgaaucuagagaauauacaaaacaccugauccgcguagagaacuggauauucagaaacccaggauucgcccuagccgcagcagucaucgccuggcuacucggauccagcacaucacagaagguaauauaccucguaaugauauuacucaucgcaccagcguauucgauccggugcaucggcguaagcaaccgagacuucguugaaggaaugucaggcgggaccugggucgacgucguccuggaacacggaggaugcguuacggucauggcacaagacaaacccacagucgacaucgaacucgucacaacgaccguaaguaacauggcagaaguacgguccuacugcuacgaagcuagcauaucagacauggcuucagacuccagaugccccacacagggcgaagccuaccuagacaaacaaucagacacgcaauacgucugcaaacgaacccucguagaccgaggcuggggaaacggcugcggccucuucggcaaaggaucgcucgugaccugcgccaaguuugcaugcuccaagaaaaugacaggcaaauccauacaacccgagaaccucgaauaccgcaucaugcucagcguccacggaucacaacacucgggaaugauagucaacgacaccgggcacgagaccgacgaaaaccgcgccaagguggaaauaacaccuaacagucccagagcagaagccacacucggcggauucgggucacucggccucgacugcgaaccacgaaccggacuagacuucagcgaccucuacuaccugacaaugaacaacaaacacuggcuuguacacaaagaaugguuccacgauauaccacucccauggcacgccggggccgauaccgguaccccacacuggaacaacaaagaggcacucguagaguucaaagacgcacacgcaaaacgccaaaccgucgucguacucgggucacaagaaggcgccgugcauacagcccucgcuggcgcccuagaagccgagauggacggcgcuaagggucgacuuuccucaggccaccuaaaaugccgccugaaaauggacaaacuccggcucaaaggggucuccuacucacucugcaccgcagccuucacuuucaccaagauacccgccgaaacccuccacggcaccgucaccgucgaaguccaauacgcaggaaccgacggacccugcaaaguacccgcucaaauggcgguagacaugcaaacccugacgcccgucggccgccuaauuaccgccaauccugucauaaccgaaucgacagaaaacagcaaaaugaugcucgaacuggacccacccuucggcgacagcuacauagucaucggcgucggcgaaaagaaaaucacccaccacuggcaccgauccgguagcaccauaggaaaagcauucgaagccaccguacggggagcaaaaagaauggcgguacugggcgacaccgcaugggacuucgggagugucggaggagcccuuaacucguuaggcaaaggcauacaccagauauucggcgccgccuucaaaagccuguucggcggcaugagcugguucagccaaauccuaaucgggacacuccuggucuggcuaggccucaacaccaagaacggauccauuagccuaaccugccuggcacucggaggaguucuaauauuccucagcaccgccgucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5165 - RNA, 2284 nt, Artificial Sequence
  KX601167.1 prME-short mRNA Design 1 opt
gggagaaagcuuaccaugacgagcguaggcauaguaggccuccuacuaaccaccgcaauggccguagagguaacccgccgaggcucagccuacuacauguaccuagaccgaagcgacgccggcgaagccaucagcuuucccacgacccuaggagucaacaaaugcuacauacaaauaauggaccucgggcacaugugcgacgcaaccaugucauacgagugcccaaugcuagacgaaggagucgaacccgaugacgucgauugcugguguaacaccaccucaacgugggucgucuacggaacaugccaccacaagaaaggcgaagcacggcggagcagacgagcagucacgcuaccaucccacucaacacgcaaacuccaaacccgaucacaaacauggcucgaaucccgcgaauacaccaaacaccuaaucagaguagaaaacuggaucuuucgcaaccccgguuucgcacucgcagcagccgcuaucgcauggcuacuaggcucauccaccucacagaaagucauuuaccucgugaugauccuacuaaucgcacccgcauacucgauccgcugcauaggaguuagcaaccgcgacuucguagaaggaaugagcggcggcacauggguagacguagugcuagaacacggcggcugcgucaccgucauggcccaggacaaacccacgguagacaucgaauuagucacuacaacggucagcaacauggcagaaguccgcucauacugcuacgaggcaagcaucuccgacauggcuuccgacagccgcugucccacgcagggcgaagccuaccuagacaaacaauccgacacacaauacgucugcaaaaggacccuaguagacagaggauggggaaacgggugcggacucuucggaaaaggcagccucgugaccugcgccaaauucgccugcucaaagaaaaugaccggaaaaagcauccaacccgaaaaucucgaguacagaaucaugcucagcguccacggaucacaacacagcggcaugauagucaacgacacggggcacgaaacggaugaaaaccgcgccaaagucgaaaucacccccaacagcccccgagccgaagccacccucggcggguucggaucgcuaggacucgacugcgaaccacgaacaggccuggacuucagcgaccucuacuaccuaacgaugaacaauaaacacuggcuaguacacaaagaaugguuucacgacaucccacuccccuggcacgccggagccgacaccggaacaccccacuggaacaacaaagaagcacugguugaguucaaggacgcacacgcaaaacgccagaccgugguugugcuaggcucacaagaaggcgcaguacacaccgcccuggcaggagcucuagaagccgagauggacggagccaaagggcgccucagcuccggacaccucaaaugccgccuaaaaauggacaaacuccgacuaaaaggagucucuuacucacucugcaccgccgcauucaccuucaccaaaauacccgcagagacccuccacggcacagugaccgucgaaguacaauacgccggaacagacggcccaugcaaaguaccggcccaaauggccguagacaugcaaacacucaccccagucggcagacuaaucacagcaaaccccgucauaacagaauccacagagaacagcaaaaugaugcucgaacuagauccgcccuucggcgauagcuacauaguaaucggugucggagacaagaagaucacccaccacugguaccgauccgguagcaccaucggcaaagcauucgaagccaccguccgaggcgccaaaagaauggcaguccucggcgacaccgcgugggacuucggcagcguaggaggagcccucaacucccucggaaaaggcauccaccaaaucuucggcgccgccuucaaaagccuauucgguggaaugagcugguucucccagauccugauuggcacgcuucuaguauggcuaggccuaaacacgaagaacggcagcauaucccucacgugccuugcgcuaggcggcguacuaauauucuuaagcaccgccguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5166 - RNA, 2284 nt, Artificial Sequence
  KX694533.2 prME-short mRNA Design 1 opt
gggagaaagcuuaccaugaccagcgucggcaucgugggccuccuccuaacuaccgccauggccgucgaagucacacgccgcggcagcgcguauuacauguaccuggacagaagcgaugccggaaaagccauaucauuccccaccacccuaggaguuaauaaaugcuacauacaaaucauggaccucggccacaugugcgacgcaaccauguccuacgaaugcccaaugcuagacgaaggcguagaaccugacgacguggacugcuggugcaacaccacaucaaccugggucguuuacggcacaugccaccacaagaaaggggaagcccgacgcuccaggcgcgcggucacccucccaucacacucaacccgcaaacuacaaacacgaucccagacuuggcuagaaucgcgcgaauacaccaaacaccucaucagagucgagaacuggaucuuccgaaaccccggcuucgcacuagcagccgcugccauagcaugguuauuaggcucgagcaccucacagaaagugauauaucucgucaugauacugcucaucgcgccagcguacuccauucggugcauaggcguaagcaacagagacuucgucgaaggcauguccggcggaaccuggguagacgucguccucgaacacgguggcugcgugaccguaauggcccaagacaaacccacaguagacaucgaacugguuaccacaaccguauccaacauggccgaagugcgcucauauugcuaugaagccagcaucucagacauggcaucggacucccgcugcccaacacaaggagaagcguaccucgacaaacaaagcgacacccaguacgucugcaaaaggacacucgucgacagaggcuggggcaacggaugcggccucuucggcaaaggcagccucguaaccugcgccaaauuugccuguagcaagaaaaugaccggcaaaagcauacaacccgaaaaccucgaauaccggauuaugcucagcguccacggcucacaacacagcggcaugaucgucaaugacauaggccacgagaccgacgaaaaccgcgccaaagucgagaucacccccaacuccccacgcgcagaggcaacucucgggggauucggcucccucggcuuagacugcgaaccccgaaccggacucgacuucucagaccuguacuaccucaccaugaauaacaaacacuggcuaguccacaaagaaugguuccacgacauaccccuccccuggcacgcaggcgcggacaccggaacaccgcacuggaacaacaaagaggcccucgucgaguucaaagacgcacacgccaaacgucaaacaguagucguacucggcucccaagaaggcgccguacauaccgcacucgccggcgcccuagaagcagaaauggacggcgccaaaggacgucuaagcuccggccaccucaaaugcagacugaaaauggauaaacuacgccucaaaggcgucagcuacucccucugcacagccgcuuucacauuuaccaaaaucccagccgaaacauuacacggaacuguuaccguagaaguccaguacgccggcaccgacggcccaugcaaagucccagcccaaauggcagucgauaugcaaacacuuacaccagucggacgccucaucacagcaaacccgguaauaaccgaaucaaccgaaaacuccaaaaugaugcuagagcucgaucccccuuuuggcgacagcuacaucgucaucggagucggggacaagaaaaucacccaccacuggcaccgcucaggcuccaccaucgggaaagcauucgaagccacaguacguggugccaaacgcauggccguacucggcgacacagcgugggacuucggcagcgucggaggcgcacucaacucacucgggaaaggcauccaccaaaucuucggcgccgcauucaaaucccuauucggcggcaugucaugguucucccaaauacuaaucggcacccuacucgucuggcuaggacucaacaccaaaaacggaagcaucagccucacgugccuagcccucggaggcguccucauauuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5167 - RNA, 2284 nt, Artificial Sequence
  KY288905.1 prME-short mRNA Design 1 opt
gggagaaagcuuaccaugacaagcaucggcaucgucgggcuccuacucaccaccgcaauggccgcagaaaucacccgaagaggaagcgccuacuacauguaccuggaccggagcgacgcaggaaaagccauuagcuucgccaccacacuaggaguaaacaaaugucacgugcagaucauggaccuaggccacaugugugacgcgacaauguccuacgaaugcccaaugcuggaugaaggaguagaacccgacgacguggacugcuggugcaacacaacuagcacaugggucgucuacggcacaugccaccacaagaaaggagaggcccgaagaucccggcgcgcagucacccuaccgucccacaguacccgcaaacuccaaaccagaagccaaacauggcuagaaagcagagaauacacgaaacaccucaucaaaguugaaaacuggaucuuccgaaaccccggauucacgcugguagcagucgcaaucgcauggcuccuagggucuagcacuucacaaaaaguaauauaccucgucaugauccuucugauagcgccggccuacagcauacgcugcaucggaguauccaauagagacuucguagaggggauguccggcggcacaugggucgacguaguccucgaacauggaggcugugucaccguaauggcccaggacaagccaaccguagacaucgagcucguaacaaccaccguauccaacauggcggaaguaagaagcuacugcuacgaagccagcaucagcgacauggccuccgacucgcggugcccaacccaaggcgaagccuaucucgacaagcaauccgacacacaguacguaugcaaaagaacccucgucgaucgcggcuggggcaacgggugcggccucuucggaaaaggcagccucguaaccugcgcaaaauuuaccugcuccaaaaagaugaccggaaaaucaauccagccagaaaaccucgaauaccgcaucaugcucagcguccacggaagccaacauagcggcaugaucguaaacgacacaggacacgaaaccgacgaaaaccgcgcaaagguagaaguaacccccaacagcccacgcgcggaagcgacgcuaggaggcuucggaagccugggacucgacugcgaaccccgcacgggccuggacuucucagaccucuacuaccucacaaugaacaacaagcacuggcuaguccacaaagaaugguuccacgacaucccacucccguggcacgcgggcgcagacaccggaacaccccacuggaacaacaaagaggcccuaguggaguucaaagacgcacacgccaaacgacaaaccguagucguccuaggcagccaagaaggcgccguccacaccgcccucgcaggcgcccuagaagccgaaauggacggagcaaaaggacgacuauucucgggacaccucaaaugcagacucaaaauggacaaacuuagacuaaaaggggucucauacagccucuguacagcagcauucaccuucacgaaaguaccggccgaaacacuacacggaaccguaacaguagagguacaauacgcagggacggacggcccgugcaaagucccagcccaaauggcuguagacaugcaaacccuaacaccagucggccgccucauaaccgcaaacccaguuaucacagaaucaacagaaaacucaaaaaugaugcuagaacuagacccacccuucggagacagcuacauagucauaggaguuggagacaagaaaauaacacaccacuggcaccggucagggagcacaaucggaaaagccuucgaagcaaccguaagaggcgcaaaaagaauggcgguccuuggcgacaccgcaugggacuucggaucaguuggaggcguguucaacucacucgggaaaggcauacaccaaauauucggagcggcauucaaaucacuauucgggggaauguccugguucagucaaauacucauaggcacccugcuaguauggcuugggcuaaacacaaagaacggauccauaagccuaaccugccucgcacugggaggcgucaugaucuuccuaucaaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5168 - RNA, 2284 nt, Artificial Sequence
  KF268950.1 prME-short mRNA Design 1 opt
gggagaaagcuuaccaugacaucaauagggaucauaggccuccuccugacaaccgcaauggcggcugagauaacgcgccgagggagcgccuacuacauguaccuagacagaucggacgcagggaaagcaaucagcuucgccaccaacuugggagucaacaaaugccacguccaaaucauggaccucggacacaugugcgacgccacaaugucuuacgagugccccaugcuagacgaagggguagaacccgacgacguggacuguuggugcaacaccacaagcaccuggguagucuacggaaccugccaccacaagaaaggcgaagcccggagaucccgccgagccguaacccuccccucccacucgacccgaaaacuccagacaagaagucaaaccuggcuugaauccagagaauacacgaaacaccuaauaaaaguugaaaacuggaucuuccgcaaccccggcuucgcccucgccgcggucgccauagccuggcuccuaggcagcucgaccagucaaaaaguaaucuaccuagucaugauccuacucaucgccccggcauacagcauacgauguaucggagugagcaaccgagacuucgucgaaggaaugagcggcggaacuuggguagacguugucuuagagcacggcggcugcguaaccgucauggcccaggacaaaccaaccgucgacaucgagcuagugaccaccacggucucaaacauggccgaagugagaucguacugcuacgaagccuccauauccgacauggcaucagacucgagaugcccaacacaaggcgaagccuaccucgacaaacaaagcgacacacaauacgugugcaaacgcacccuaguagacagaggauggggcaacggaugcggacucuucggaaaaggcagccuagucacuugcgcgaaauucacaugcagcaagaaaaugaccggcaaaagcauacaaccggaaaaccuagaauaccgcaucaugcucagcguacacgguucacaacacuccggcaugaucgucaacgacauaggacacgaaaccgacgaaaaccgcgcaaaaguggaagucaccccaaacucaccgagagcagaagcaacacucggcggauucggaucacuaggucucgacugcgaaccgcgcacuggccuagacuucuccgaccucuacuaccuuacaaugaacaacaagcacuggcuaguccacaaagaaugguuccaugacauuccguugccauggcacgcaggagccgacacaggaacaccacacuggaacaacaaagaagcgcuaguagaguucaaagacgcccacgccaagcgucaaaccgugguaguccuaggaagccaagaaggcgccgugcacacagcacuagccggagcacucgaagccgaaauggacggugccaaagggcgacuauucagcggccaccucaaaugcaggcucaaaauggacaaacugcgacuaaaaggaguaucguacucacuaugcaccgccgccuucacauucacaaaaguaccggccgaaacccuacacggcacaguaaccguggaaguccaguacgcaggaaccgacggaccuugcaaaguccccgcccaaauggccgucgacaugcaaacacucacacccgucggcagacugauaaccgcaaacccaguaaucaccgaaagcacugagaacagcaaaaugauguuagaacuagaucccccauucggcgacucauacaucgucaucggagucggcgacaagaaaauaacccaccacuggcaccgcaguggcucaaccaucggcaaagcauucgaagccaccguacgcggcgccaaacgcauggcaguccucggugacacagcaugggauuucggaagcgucggcggcgucuucaacucccucggcaaaggugugcaccaaaucuucggcgccgccuucaagagccucuucggaggcaugucgugguucucacaaauccuuaucgggacacuccuagucuggcuaggacuaaacaccaagaacggcaguaucagccuaaccugccucgcccuaggcgggguaaugauauuccuaagcacggccguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5169 - RNA, 2284 nt, Artificial Sequence
  KF383121.1 prME-short mRNA Design 1 opt
gggagaaagcuuaccaugaccuccaucgggaucauaggccuauuacuaaccaccgcaauggcagccgagaucacccggcgcgguagcgccuacuacauguaccucgauagaucagaugcaggcaaagcaauauccuucgcaaccacacucggaguaaacaagugccacguccaaaucauggaccuaggccacaugugcgacgcaacaaugucauacgaaugcccaaugcuagacgagggcgucgaacccgacgacguagacugcuggugcaacaccacaagcacauggguagucuacggaacaugucaccacaagaaaggagaggccaggagaagccgacgcgcagucacccucccaagccacucgacacgaaaacuccaaacacgcagccaaacauggcuggaaagccgcgaauacaccaaacaccucaucaaaguagaaaacuggaucuuccgcaacccaggcuucgcacucguagccguagccauagccuggcuccugggaagcagcaccagccaaaaagucauauaccucguaaugauccuccugaucgcaccagccuacucgaucaggugcauuggcgucagcaaccgagacuucgucgaaggcauguccggaggcacauggguagacgucgugcuagagcacggcggcugcgucacggucauggcccaagacaaacccacgguggacauugaacucguaaccaccacagucagcaacauggcugaagucagaagcuacugcuacgaggcaucgaucagcgacauggccagugacucaagaugcccaacacaaggggaagcauaccucgacaaacagucagacacccaauacgucugcaagcgaacacucguagaccgcggcuggggcaacggcugcggacucuucggcaagggcucucuggucacaugcgccaaauucacguguagcaagaaaaugacuggcaaaucaauccaaccagaaaaucucgaauaccgaaucaugcuauccguacacggcucacaacacagcggcaugauaguaaaugacauaggucaugaaacugacgaaaacagagcaaaagucgagguaacccccaacagcccgcgcgcugaagcaacgcucggcggcuucgggagccuaggacucgacugcgaaccccgaacgggccuagacuuuagcgaucuguacuaccucacaaugaacaacaaacacuggcucgugcacaaagagugguuccacgacaucccccuccccuggcacgccggagccgacaccggcacaccccauuggaacaacaaagaagcccucguggaguucaaggacgcacacgcaaaacggcaaaccguagucguccuaggaucacaggaaggcgccguccacaccgccuuagcgggagcacucgaagcagaaauggacggcgccaaagggcgccuauucuccggacaccugaagugucgucucaaaauggacaaacuccgacuaaaaggaguguccuacagccucugcaccgcagcauucacauucaccaaaguccccgccgaaacccuccacgggacaguaacagucgaaguccaauacgccgguacagacggaccaugcaaaguccccgcccaaauggcaguagacaugcaaacacuaacccccgucgggcgacucaucaccgccaaccccguuauaacagaaagcacggaaaacagcaaaaugaugcuggaacuugacccucccuucggggacucauacauaguaauaggcgucggagacaagaaaaucacacaccauuggcaccgaagcggauccacaauaggaaaagcauucgaagccaccguacgaggggcaaaacggauggcaguacuaggcgacaccgccugggacuuuggcucaguaggcggcgucuucaacagccucgggaaaggcauccaccaaauauucggugccgccuucaaaucacucuucggcggaaugagcugguucagccaaauccugauuggaacccuacucgucuggcugggcuuaaacaccaaaaacggcagcaucucccugacaugucucgcccuagggggaguaaugauauuccuaucaaccgccgucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5170 - RNA, 2266 nt, Artificial Sequence
  KF268949.1 prME-short mRNA Design 1 opt
gggagaaagcuuaccaugacaagcauagguaucauagggcuucuacucacaaccgccauggcagccgaaaucacccgacggggcuccgccuacuacauguacuuagacagaagcgacgcaggaaaagccaucucauucgccaccaaccuaggagucaacaagugccacguacaaauaauggaccugggacacaugugcgacgccacuauguccuacgaaugccccaugcucgacgagggcgucgaaccagacgacguugacugcuggugcaacaccacaagcacaugggucgucuacgggaccugccaccacaagaaaggcgaagcacgccggagccggcgcgccgucacgcuuccgagccacagcacccgcaaacuacaaacaagaucacagacguggcucgagagcagagaauacaccaagcaccucaucaaaguagaaaacuggauuuuccgcaaccccggauucgcucuagccgcagucgcaaucgccuggcuccuaggcucgagcacaagccaaaaagucaucuaccuaguaaugauccuccuaaucgcacccgcauacucaauacgcugcauaggcgucagcaaccgcgacuuuguagaaggaaugucaggagggacauggguagacguaguccucgaacacggaggcugcgucaccgucauggcacaggacaaacccaccguagacauagagcucguaaccacaacaguaagcaauauggcggaaguccguuccuacuguuacgaggcuucaaucucagacauggcgucagacucacgaugucccacccaaggcgaagcauaccuggacaaacaaucagacacccaauacguauguaaaaggacccucguugaccgcggcugggggaacggaugcgggcuauucggaaaaggaucccucgucaccugugccaaauucacaugcucaaagaaaaugaccggaaaaucaauccagccggaaaaccuagaauacaggauaaugcucucaguccacggaagccaacacagcggaaugauagucaacgacgaaaacagggccaaagucgagguuacacccaacagcccacgcgccgaagcaacacuaggaggauucgggagccuaggucuugacugcgaaccgcgaaccggccuggacuucucagaccucuacuaccuaaccaugaacaacaaacacuggcucguacacaaagaaugguuccacgacaucccgcucccguggcacgccggagcagacacaggcaccccacacuggaacaacaaagaggcccucguagaguucaaagacgcccacgcgaaacgccaaacaguaguaguacuggguucccaagaaggcgcaguccacaccgcgcuagcaggcgcacuagaagccgaaauggacggagccaaaggacgucuauucuccggacaccucaaaugccggcuaaaaauggacaaacuaagacucaaaggaguaucguacucccucugcacagccgccuuuacauucacgaaggucccagccgaaacccuacacggaaccgugaccgucgaaguacaauaugcgggaaccgacggcccaugcaagguaccagcccaaauggcagucgacaugcaaacccucacgcccgucggacgccucaucacagcaaauccaguaaucacagaaagcaccgaaaauucaaaaaugaugcuggaacuagacccacccuucggagacagcuacaucguaaucggcgucggagacaagaaaaucacacaucacuggcauaggagcgggagcacaauuggaaaagccuucgaagcaaccguaagaggcgccaaacgaauggcgguccuaggugacacagccugggacuucggcagcgucgggggcgucuucaacagccuaggcaaaggcauccaccaaauauucggagcagccuuuaaaagccuauucgguggcaugucaugguucagccagauccucauaggaacccugcuagucuggcuaggacuaaacacgaaaaacgggagcauaagccugacaugccucgcucugggaggcgucaugauauucuuaagcacggccguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5171 - RNA, 2284 nt, Artificial Sequence
  KU955595.1 prME-short mRNA Design 1 opt
gggagaaagcuuaccaugaccagcauaggaauaguaggccuccuacucacaaccgccauggcggcggagaucaccagacgaggcagcgcauacuacauguaccucgacaggucagacgccgggaaagcaaucagcuucgcaaccacacugggagucaacaaaugccacguacagauaauggaccugggacacaugugugacgcaaccaugucauacgagugccccaugcuagaugaaggaguagagcccgacgacguagacugcuggugcaauacaaccagcacaugggucguguacggaaccugccaccacaagaaaggcgaagcuagaagaagccgcagagcgguaacccuaccaagccacagcacgcgaaaacuccaaacccgaagccaaaccuggcuugagagccgggaauacacgaaacaccuaaucaagguagaaaacuggauauuccgcaaucccgguuucgcgcucgucgcagucgcaauagcauggcuccuaggaagcagcacaagccagaaagugauauaccuaguaaugauccuacugauagccccagcguacagcauccgcugcaucggcguaagcaaccgcgacuucguagaaggaauguccggaggcacauggguagacguaguccucgagcacggcggcuguguaacaguaauggcacaagacaaaccaacggucgacauagagcuagucaccacaacaguaagcaacauggcagaagugcgaagcuacugcuacgaagcauccaucucagacauggccagcgacagucgaugccccacacaaggcgaagcauaccuagacaaacaauccgacacccaauacgucugcaaaagaacgcuagucgauagagguuggggcaacggcugcggauuauucggcaaaggcucgcuagugacaugcgcgaaauucacaugcagcaagaaaaugacgggcaaaagcauccagcccgaaaaccucgaguacagaauaaugcuauccguccacggcagccaacacagcggcaugauagucaacgacacugggcacgaaacagacgaaaacagggccaaaguagaagucaccccaaacagcccacgcgcggaagcgacccucggaggguucgggucacucggacuagacugcgaaccacgaacagggcucgacuucuccgaccucuacuaccuaacgaugaacaacaaacacuggcugguacacaaagagugguuccacgacauacccuugccauggcacgcaggggcggacacaggaaccccacacuggaacaauaaagaggcgcuagucgaguucaaagacgcacacgcaaaacgacaaacaguaguaguacuaggaagccaagaaggcgcaguacacacagcacuagccggcgcgcuggaagccgaaauggacggcgcaaaaggacgacuauucagcggccaccugaaaugcaggcucaaaauggacaaacugagacugaaaggagucuccuacucacuaugcacagcagcauuuaccuucacgaaaguaccagccgaaacccuacacggaacaguaacgguagaaguccaguacgcaggaacagacgggccaugcaaaguaccagcacagauggccgucgacaugcagacccucacaccagucgggcgccuaauuacagccaacccgguaaucacagaaagcaccgaaaacuccaagaugaugcuagaacuagacccacccuucggcgacagcuacaucgugaucgguguaggugacaagaaaaucacacaccacuggcaccggagcggcagcacaauagggaaagccuucgaagcgacaguacgcggcgcgaaacgcauggccguacucggcgacaccgcaugggacuucggaagcgugggcggcgucuucaacagccucggaaaagguauccaccaaaucuucggggcagccuucaaaagccucuucgggggaaugagcugguucucacaaauacuuauagggacacugcuaguauggcucggccucaacaccaaaaacggaagcauaagccuaaccugccuagcacugggaggcgugaugauauucuuaagcacagccgucucggcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5172 - RNA, 2284 nt, Artificial Sequence
  KF383116.1 prME-short mRNA Design 1 opt
gggagaaagcuuaccaugacgagcauaggaaucgucggacuacuacuaaccaccgcaauggccgcagaaaucacacgcagaggaagcgcauacuacauguaccuagauaggagcgaugccggcaaagccaucagcuucgcgacaacacuaggugucaacaaaugccacguacaaauaauggaccuaggccauaugugcgacgccaccaugucauacgaaugccccaugcuagacgaaggcgucgaaccagacgacguggacugcugguguaauaccacauccaccuggguagucuacggcacaugccagcacaagaaaggagaggcacgacgcucaagacgagcgguaacacuacccagccacucaacccgcaaacugcaaacgcgcucacaaacauggcuagaaucaagggaauacacaaaacaccuaauaaaagucgaaaacuggauauuccgcaaccccggcuucgcacuggucgcaguagcaauagcguggcuccuaggcucgaguaccucccaaaaagucauauaccucgucaugauccuccucauagccccagcauacuccauccgcugcaucggcgucagcaacagagacuucguagaaggcaugucuggaggcacauggguggacguggugcuagaacacggaggcugcgucaccguaauggcccaagacaaacccacagucgacaucgaacucgucacaaccacgguuagcaacauggcagagguacgcuccuacugcuaugaagccagcauaucagacauggcaagcgacucgcgcugccccacccaaggcgaagccuaccucgacaaacaaagugacacgcaauacguaugcaaaagaacccuagucgaccgaggcuggggaaacgguugcggccucuucggaaaaggcagccuaguaacaugcgccaaauucacaugcuccaagaaaaugacagggaaaagcauacaacccgaaaaccuggaauacagaaucaugcuuagcguacacggcagccaacauucagguaugauaguaaacgacaucggccacgaaaccgaugagaaccgcgccaaaguagaagucacccccaauuccccgcgcgccgaagcaacccuaggcggauucggaucacucggccuugacugcgaaccccgcacaggacucgacuucagcgaccucuacuaccuaacaaugaacaacaaacacuggcucguacacaaagagugguuucacgacaucccccuacccuggcacgccggagccgacaccggaacaccccacuggaacaacaaagaagcccuaguggaguucaaagacgcacacgccaaacgccaaaccguagucguccuaggcagccaagaaggcgccguccacacugcguuagcaggagcauuggaagccgaaauggacggggccaaaggucggcuauucagcggccaccugaaaugccgccucaaaauggacaaacuucgccuaaaaggcgucuccuauucacucugcaccgccguaugcacagcagccaaaguaccggcggaaacccuacacggcaccguaacggucgaaguacaauacgcaggaacagacgguccaugcaaaguacccgcucaaauggccguagacaugcaaacccucacccccguaggcagacuaaucaccgccaacccaguaauaaccgaaagcacggaaaacuccaaaaugaugcuagaacuagacccgcccuucggcgacagcuacaucgucauuggaguaggggacaagaaaaucacacaccacuggcacagauccggauccacaauaggcaaagcguucgaagcaaccguccgcggcgcaaaacgcauggccguccucggcgacacggcgugggacuucgguucaguaggcggagucuucaacucccuaggcaaaggaauacaccaaaucuucggcgccgcauucaaaucgcuguucggcggcaugucgugguucucacaaauacucaucgggacccuccuaguauggcugggacucaauaccaaaaacggaucaaucucacucacaugccuggcgcugggcggcguaaugauauuccuaucaacagcagucucggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5173 - RNA, 2266 nt, Artificial Sequence
  KX601166.1 prME-short mRNA Design 1 opt
gggagaaagcuuaccaugacuagcaucggcaucgucggccuccuacugaccacagcuauggcagcagaaaucacccgacggggguccgcauacuacauguaccuagaccgcucagacgccggaaaagcgaucuccuucgcaacaacgcuaggagucaacaaaugccacguccaaaucauggaccuaggccacaugugcgacgcuacaaugagcuacgaaugccccaugcuagaugagggcguagaacccgacgacgucgacugcuggugcaacaccacuagcacguggguaguauauggcacaugccaccacaaaaagggagaagcacggcggagccgacgcgcaguaacacucccaagccacagcacacgaaaacuccaaacccguagccaaacguggcucgaauccagagaauacaccaaacaccuaaucaaaguagaaaacuggaucuuccgaaacccaggcuucgcccucguagcagucgcaauagcauggcuccuaggauccaguacaagccagaaaguaaucuaccuaguaaugauccuccuaauagcacccgccuacuccaucagaugcauaggcguaagcaaccgagacuuuguggaaggaauguccggcggaacauggguagacgucgugcuggaacacggaggcugcguaacgguaauggcgcaagacaaacccaccguagacaucgaacuggucaccaccaccguaucaaacauggcagaaguacgcuccuacugcuacgaagcgucaauaucagacauggccucggacucccggugcccaacccaaggcgaggcauaccuagacaaacaauccgacacccaauacgucugcaaacgaacccugguugaucgaggaugggguaacggcugcggacucuucgguaaaggcagucuagucaccugugcaaaauucacaugcucaaagaaaaugaccggaaaaucaauucaaccagaaaaccucgaauaucgaauaaugcucucaguacacggaagccaacacucaggcaugauagucaaugacgaaaaccgcgccaaaguugaagucaccccaaacagucccagagcagaagccacgcucggcggguucgggagccuaggacuggacugugaaccccggacgggccuggacuucagcgaccuauacuaccucaccaugaacaacaaacacuggcuaguacacaaagaaugguuucacgauauaccccucccguggcacgccggcgccgauaccggcacuccccacuggaacaacaaagaagcacuggucgaguucaaagacgcacacgcaaaacgccaaacugucguaguccucgggucccaagaaggcgccguacacacagcacucgccggcgcgcucgaggcagaaauggacggcgccaaagguagacucuucucaggacaccuaaagugccgccuuaaaauggacaaacuccgccucaaaggagugucguacuccuuaugcaccgccgcauucaccuucacaaaaguaccagccgagacacuccacggcaccguaaccguagaaguacaauacgccgggaccgacggaccaugcaagguacccgcacaaauggccguagacaugcaaacacucacgccagucggacgccucaucaccgcaaaucccgucaucacagaguccaccgagaacuccaaaaugaugcucgaacucgaucccccauucggcgacuccuacauagucaucggcgucggagacaagaaaaucacccaccacuggcaccgauccggcucgaccaucggcaaagccuucgaagccaccguaagaggcgccaaacggauggccguccugggcgacacggccugggacuucggauccgucgguggcguuuucaacucacucggaaaaggaauccaccaaaucuucggagccgccuucaaaucacuauucggaggcauguccugguucagccaaauccucaucggaacccuacucgucuggcuuggucucaacaccaaaaacggcagcaucagcuuaacaugccucgcacucggaggcguaaugaucuuucucuccaccgccgucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5174 - RNA, 2284 nt, Artificial Sequence
  KF383118.1 prME-short mRNA Design 1 opt
gggagaaagcuuaccaugacaagcauuggcauuauaggccuacuucucaccacugccauggccgccgaaauaacacgacgaggaagcgccuacuacauguaccuagacagaucggacgcaggcaaagcaaucagcuucgcaacaacccucggagucaacaaaugccacguacaaaucauggaccuaggacauaugugcgacgcaacaaugucauacgaaugccccaugcuggacgaaggcgucgaacccgacgacguagacugcuggugcaacaccacaaguaccuggguagucuacggaaccugccaccacaaaaagggagaaacccgacggucccgcagaucaguaucccuccgcuaccacuacacaagaaaacuccaaacccgaagccaaaccuggcucgaaucccgcgaauacaaaaaacaccuaaucaugguagaaaacuggauauuccggaacccaggauucgccaucgugaguguagccaucacauggcucaugggcagucugaccagccaaaaagucaucuaccucguaaugaucgugcuaauaguacccgccuacagcaucucaugcaucggcgucucaaaccgcgaccucguagaaggaauguccggaggcaccugggucgacgugguucucgaacauggaggaugcgugacggaaauggcccaagacaaaccaaccgucgacaucgaacucguaacgaugaccgucagcaacauggcagaagucagauccuacugcuaugaagcgucccucagcgacauggcaagcgccagccgaugccccacacagggcgagcccucacucgacaaacaaucagacacacaaagcgucuguaaaagaacccucggggaccgaggcuggggcaacgggugcggcauauucggaaaagguucgcuaguaacaugcucaaaauucaccugcugcaaaaaaaugcccggcaaaucgauacaaccagagaaccucgaauacagaauaaugcuacccguacacgggagccaacacagcggcaugauaguaaacgacauaggacacgagacagacgagaacagagcaaaaguagaagucacgccaaauuccccgcgagccgaagcaacacucggaggcuucggaagccuagggcucgacugcgaaccacgcaccggccucgacuucucagaccuauacuaccugaccaugaacaacaaacacuggcuuguccacaaagaaugguuccacgauaucccucuacccuggcacgccggagcagacaccggcacaccccacuggaacaacaaagaggcccugguagaguucaaagacgcacacgcaaaacgucaaaccgucguggucuuaggcagccaagaaggcgccguacacaccgcacucgccggcgcccucgaagcggagauggacggggcuaaaggacgccuguucucaggccaucucaaaugccgucuaaaaauggacaaacuaagacuaaaaggaguaucguacagccucugcaccgccgccuucacauucaccaaaguaccggcagaaacacugcacggaacagugacaguggaaguccaaagcgccggaacagauggacccugcaaaguccccgcccagauggccguagacaugcaaacacucacacccguaggccggcuaaucacagcaaacccgguaaucaccgagucaacagaaaacuccaaaaugaugcuggaacuggauccgccauucggagacucauacauagucauagguguaggagacaagaaaauaacccaccacuggcaccgaagcggcagcaccauaggaaaagccuucgaagccacgguacgcggagccaaaagaauggccgugcucggagacaccgccugggacuucggcucaguagggggcguauucaacagccuaggaaaaggcauacaccaaaucuucggagcagcauuuaaaagccuauucggaggaaugagcugguucucacaaauacuaaucggaacccuacuaguguggcuaggacucaacaccaaaaacggcagcaucucacucacgugccuagcccugggaggagucaugauauuccucuccacagccguauccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5175 - RNA, 2281 nt, Artificial Sequence
  KX447520.1 prME-short mRNA Design 1 opt
gggagaaagcuuaccaugagcguaggcauagucggccuacuccugacgaccgcaauggccgcagaagugacacggcggggcagcgccuacuacauguaucuggacagaaacgacgcgggggaagccaucucauucccaacgacccuaggcaugaacaaaugcuacauacaaauaauggaccuagggcacaugugcgacgcaacgauguccuacgagugcccgaugcucgacgaagguguagaaccagacgacgucgauugcuggugcaacaccacauccacauggguaguauacggcacuugccaccauaagaaaggggaagcacgccgcagccgacgcgccguaacacucccuagccacuccacgcgcaaacuacaaacaagaagccaaaccuggcuagaaucuagagaauacacgaaacaccugauaagaguagaaaacuggaucuuccgaaacccgggauucgcccucgccgcagccgccauagcauggcuccucggaagcaguaccagucaaaaaguaaucuaccugguaaugauccuccuaaucgcacccgcguacagcaucaggugcaucggcgugagcaaccgcgacuucguagaagggaugagcggcggaacaugggucgacgucguccuagagcacggaggaugcgucacaguaauggcacaagacaaaccuacgguagacaucgagcucgucaccaccaccguaaguaacauggccgaaguacggucauauugcuacgaagcauccauaagcgacauggccagcgacucccgauguccaacucaaggagaagcauaccuagacaaacaaucggacacacaauacguaugcaaaagaacccucguagacagaggauggggcaacggaugcggacuauucggaaaaggcucgcuaguaaccugcgccaaauucgcgugcuccaagaaaaugacaggaaaaagcauucaaccagaaaaccuagaauacagaauaaugcuguccguacacggaagccaacauagcggaaugaucgucaacgacaccggacacgaaacggacgagaacagagcaaaaguagaaaucaccccaaacaguccccgcgcagaggcgacgcuaggagguuucggaagccuaggacuggacugcgaaccccgcacgggccucgacuucagcgaccuguacuaccucaccaugaacaacaaacacuggcuagugcacaaagaaugguuucacgacaucccccuaccguggcacgcaggcgcagacacaggaacaccgcacuggaacaacaaagaagcacuggucgaguucaaagacgcccacgcaaaaagacagacaguggugguccugggcagccaagagggagccguacacacagcgcucgcgggagcacuggaagccgagauggacggcgcaaaaggacgccuguccucaggacaccucaaaugccgacuaaaaauggacaaacucagacucaaaggagucagcuacucacuuuguacagccgccuucacauucacaaaaauaccagccgaaacacuacacggaacaguaaccgucgaaguacaguacgcaggaacagacggaccgugcaaaguccccgcgcaaauggcaguagacaugcaaacccugaccccagucggacgacuaauaaccgcaaaccccguaaucacagaauccaccgaaaauuccaaaaugaugcucgagcuagacccacccuucggcgacagcuacauagugaucggcgucggggaaaagaaaauaacccaccacuggcaccgaagugggaguacaauaggcaaagcauucgaggcaaccgucagaggggccaaacgaauggcaguacugggagacacagcaugggacuucggaucagugggcggagcccuaaacucacucggaaaaggaauccaucaaaucuucggggccgcguucaaaucacucuucgguggcaugagcugguucagccaaauacucauaggcacacuccuaauguggcucggacugaacacgaaaaacggaagcauaagccugaugugccuggcacuaggcggcguccucauauuuuuaaguacagccguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5176 - RNA, 2284 nt, Artificial Sequence
  KU761561.1 prME-short mRNA Design 1 opt
gggagaaagcuuaccaugaccuccguggggauagucggacuacuccugacaaccgccauggccgccgaaguuacccgacgaggcagcgccuacuacauguaccucgaccgcaacgacgccggcgaggcaaucuccuuccccaccacgcuaggcaugaacaaaugcuacauacaaaucauggaccucggacacaugugcgacgcaacaaugagcuacgaaugccccaugcucgacgagggagucgaacccgacgaugucgacugcuggugcaacacaaccagcaccugggucguguacggaaccugccaccacaaaaagggcgaagcgcgccgcucccggcgcgccgucacccuccccagccacucaacacgaaaacuacaaacacgaagccaaacauggcuggaaucacgagaauacaccaaacaccuaauacgagucgaaaacuggauauuccgaaaccccggcuucgcacuagccgccgcggccauagccuggcuccucggcucaucaaccucccaaaaaguaaucuaccucguaaugauacuccuaauagcccccgcauacucgauaagaugcauaggcgucagcaaccgcgacuucguagaaggaaugagcggcggcaccugggucgacguuguccuagaacacggcggaugcgucacaguaauggcccaagacaaaccuaccgucgacauagaacucgucacaacaaccguuuccaacauggccgaaguacgaucauacugcuacgaggcuucaauauccgacauggccucggacucccgcugccccacccaaggcgaagccuaccucgacaaacagagcgacacccaauacgucugcaaacgcacgcuagucgaccgcggauggggcaacggcugcggacuauucgggaaaggaucccuaguaacaugugcaaaauucgccugcucaaagaaaaugacggguaaaucaauccaaccggaaaaccucgaguaucgaaucaugcucuccguccauggcucccaacacuccggcaugauaguaaaugacacaggccacgaaaccgaugaaaacagagcuaaaguugaaauaacccccaacucaccacgcgccgaagccacccugggcggcuuuggaucacugggccucgacugcgaaccccgaaccggucucgacuucagcgaccuguacuaccuaacaaugaacaacaaacacuggcuaguccacaaggagugguuccacgacaucccacucccauggcacgccggagcagacacaggcaccccacacuggaacaacaaggaagcccuagucgaguucaaagacgcacacgcaaaacgacaaacggucgucguccuagggagccaagaaggagcaguacacacagcacucgcaggggcgcuagaagcagaaauggacggggcaaaaggacgccuuuccagugggcacuuaaagugcagacucaaaauggacaaacuuagauuaaaaggcguaucauacucacuaugcaccgccgccuucaccuucaccaaaauacccgccgaaacgcugcacggaacagucacgguugaaguccaauacgccggcacagacgggcccugcaaaguacccgcgcaaauggcggucgacaugcagacacuuacccccguuggucggcuaauaacggccaacccagucauaacagaaagcaccgaaaacuccaaaaugaugcuagaacucgacccacccuucggagacagcuacaucgucaucggcguuggcgaaaagaaaaucacacaucacuggcacagaucagguagcaccauaggcaaagccuuugaagccacagucagaggcgccaggcguauggcaguccucggagacaccgccugggacuuuggauccgugggaggcgcacuaaacucccuaggcaaaggcauccaucaaauauucggggccgccuucaaaucgcuguucggcggaaugucaugguucagccaaauccuaaucggaacgcuccuuauguggcucggccuaaacaccaaaaacggauccauaucccucaugugccuggcccucggaggcguccuaaucuuccuguccacagcggucuccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5177 - RNA, 2284 nt, Artificial Sequence
  KX806557.2 prME-short mRNA Design 1 opt
gggagaaagcuuaccaugaccuccguuggcaucgugggccuccuccuaacaaccgcaauggccgccgaaguaacccgacguggaagugcauacuacauguaccuagaccgcaacgacgcaggagaagcaaucucauucccaaccacccuaggcaugaacaaaugcuacauccaaaucauggaccuaggccacaugugcgacgcaaccaugucauacgaaugccccaugcuagacgaagguguugaaccagacgacguagacugcuggugcaacacaacauccaccuggguagucuacggcacaugccaccacaaaaagggagaagcacggcgcucccgccgagccgucacccugcccagucacuccacccgcaaacuccaaacccgaucccaaaccuggcuagaaagccgcgaauacacaaaacaccuaauaagaguagaaaacuggauguucagaaaccccggauucgcccucgccgcagcagccauagcauggcuccucggcucauccaccucacaaaaaguuauauaccucgucaugauccuacuaauagccccagccuauagcaucagaugcaucggcgucuccaaccgagacuucgucgaaggaaugucaggaggaaccuggguggacgucgugcucgaacacgggggcugcgugaccguaauggcacaagacaaaccaacgguagacaucgagcuagucacaacaacuguguccaacauggccgaaguacgaagcuauugcuacgaagcauccaucucggacauggccagcgacucucgaugccccacccaaggcgaagcauaccuggacaaacaauccgacacccaauacguaugcaaacguacucuaguagaccgcggcugggggaacgguugcggacuguucggaaaagggucacugguaaccugcgcaaaguucgcgugcucuaagaaaaugaccggaaaauccauccaaccagaaaaccuagaauaccgcaucaugcuauccguccacggaucccagcacaguggaaugauugucaacgacaccggacaugaaacagacgaaaaccgcgccaaaguagaaauaacaccaaacucaccccgcgccgaagcaacacucggcggauucggcucacucggacucgacugcgaaccccgcaccggccucgacuucucagaccuguacuaccucacaaugaacaacaaacacuggcucguacacaaagaaugguuccacgacauaccacucccuuggcacgcgggcgccgacacagguaccccacacuggaacaacaaagaagcccuagucgaguucaaagacgcacacgccaaaagacagacgguagucgugcucggaagccaggaaggagccguacacaccgcccucgccggggcacuggaagcagaaauggacggcgcuaaaggccgccucucauccggccaccuaaaaugccgguuaaaaauggacaaacugagacucaaaggaguaagcuacuccuuaugcaccgccgccuucaccuucaccaaaauaccggccgaaacccuccacgguaccguaacaguagaaguccaauacgccggaacagacggccccugcaaagucccugcccagauggcugucgacaugcaaacccucacccccgucggaagacuaaucacugccaaccccgucauaaccgaauccaccgaaaacagcaaaaugauguuggaacucgaucccccauuuggcgacucauacaucgugauaggcguaggcgagaaaaagauaacacaccacuggcaccguuccggaaguaccaucggcaaagcauucgaagcgaccguccgaggcgcaaaacgaauggccguacucggggacacggccugggacuucgggagcgugggcggcgcacuaaacucccucggcaaaggaauccaccaaaucuucggcgccgccuucaagucccucuucggaggcaugucgugguucucccagaucuuaaucggaacucuacucauguggcuaggguugaacaccaaaaacggaucaauaucccuaaugugcuuagcccuuggaggaguacuaaucuuccuaagcaccgcagugucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5178 - RNA, 2284 nt, Artificial Sequence
  LC191864.1 prME-short mRNA Design 1 opt
gggagaaagcuuaccaugaccaguguaggcauagugggacuacuacucacuaccgccauggcagccgaaguaacaaggcgaggauccgcguacuacauguacuuagaccgcaacgacgcaggagaagcaaucuccuuucccaccacacucggaaugaacaaaugcuacauccaaauaauggaccuaggccacaugugcgacgccacaauguccuacgaaugcccgaugcucgacgaaggagucgagccagaugacguagacugcuggugcaacaugaccagcaccugggucgucuacggcaccugccaccacaaaaaaggagaggcgcgaagauccagacgggccgucacacuaccaagucacuccacgcguaaacuccagaccagaagccaaaccuggcucgaaucgcgagaauacacaaaacaccuaauccgcgucgagaacuggauauuccguaaccccggauucgcccuagcagccgccgcaaucgccuggcuacuaggcagcucaaccagccaaaaaguuaucuaccuugucaugauacuccucauugcgccagcauacucgaucagauguauuggugucaguaaccgcgacuucguagaaggcauguccggcggaacaugggucgacgucguucucgaacacgggggaugcgucaccgucauggcacaagacaaaccaaccgucgacauagaacucguaacuacaaccgucuccaacauggccgaaguccgcagcuacugcuacgaagccagcaucucagacauggcgagcgauucccgcugccccacgcaaggcgaagccuaccuagacaaacaaagcgacacccaauacguauguaaacggacccucgucgacagaggauggggcaacggcugcggccuuuucggcaaaggcagccuaguaaccugcgccaaauucgccugcagcaaaaaaaugaccggaaaaagcauucaaccugaaaaccuagaguaccgcaucaugcucuccguccacggaucgcaacacuccggcaugauagucaaugacaccggacacgaaaccgacgaaaaccgugcgaaaguggaaaucaccccuaauagccccagggccgaagccacacucggcggauucggcagccuagggcuagacugcgaacccagaacaggccuagacuucagcgaccuauacuaccucacaaugaacaacaaacacuggcuaguccacaaagaaugguuccacgacaucccacuaccauggcacgcuggagccgacacagggacuccccacuggaacaacaaagaagcgcucguagaguucaaagaugcacacgcaaaacggcaaacagucguaguccuaggcucacaggaaggcgcgguccauacagcccucgcaggagcacucgaagcagaaauggacggagccaaaggccgacuaagcagcgggcaccucaaaugcagacucaaaauggacaaacucagacugaaaggcguaagcuacagccuuugcacagcagccuucaccuuuaccaaaauacccgccgaaacccuacacggcaccguaacgguagaaguucaauacgcaggcaccgacggaccaugcaagguccccgcacaaauggccgucgauaugcagacccuaacccccgucggacgccucaucaccgccaacccagucauaaccgaaagcacagaaaacucgaaaaugaugcucgaacuagacccacccuucggagacucauacaucguaaucggagucggagaaaaaaaaauaacacaucacuggcaccgauccggcucaacaauaggcaaagccuucgaagcaacaguacgaggagcgaaacggauggccguacucggagacacagccugggacuucggcagcgucggaggagcccucaacagcuuaggaaaaggcauccaccaaauauucggagccgcauucaagucccuguucggcggcauguccugguucagccaaauacuaauaggcacgcuacugauguggcucggacucaacaccaaaaacggcagcaucagccucaugugccucgcgcucggaggcguccucauauuccuuucaaccgcagucucagcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5179 - RNA, 2284 nt, Artificial Sequence
  KU744693.1 prME-short mRNA Design 1 opt
gggagaaagcuuaccaugacaagcgucgggaucgugggccuccuacuaacgaccgcaauggcagcagaggucacccgcagaggaagcgcauacuacauguaccuagaccgaaacgacgccggagaagcaaucagcuuccccacaacccucggcaugaacaaaugcuacauacagaucauggaccuaggacacaugugcgacgccaccaugagcuacgaaugcccgaugcuagacgaaggcgucgaaccagacgacgucgacugcuggugcaacacaacaagcacauggguagucuacggaaccugccaccauaagaaaggcgaagcgcgcagaagccggcgagcaguaacccuaccaagccacuccacaagaaaacuacaaaccagaucacagaccuggcucgaaagccgggaauacaccaaacaccucauccgcgucgaaaacuggaucuucagaaaucccggcuucgcccuagcggcagccgccaucgccuggcuauuaggcagcaguaccucccagaaaguaauauacuuagucaugauacuacuaauagcgccagcguacucgauacgaugcauaggagucagcaaccgagacuucgucgaaggcaugagcggagggacguggguggacguaguacucgaacacggaggcugcgucacggcgauggcucaagacaaacccacagucgacaucgagcuagucaccacaaccguaagcaacauggccgagguaagaucauacugcuacgaggcauccauaagcgacauggcaagugacucaagaugccccacacaaggagaagcauaccucgacaaacaguccgacacccaauacgucuguaaaagaacccuaguagacagaggcuggggcaacgggugcggacuauucggcaaaggcagccucgugacaugcgcgaaauucgcuugcuccaagaaaaugacaggcaaauccauccaacccgaaaaccucgaauaccgcauaaugcuaagcguacacgggucccaacacuccggcaugcuggugaacgauaccggacacgagaccgacgaaaacagagcgaaaguagaaauaaccccaaauagcccgcgagcagaagcaacucuaggcggauucggcagccuuggacuagacugcgaaccaagaacaggccucgacuucucagaccuauacuaccucaccaugaacaacaaacacuggcucgcgcacaaagaaugguuccacgauaucccccuccccuggcacgcaggcgcagcaacgggaacaccacacuggaacaacaaagaagcccucgucgaguucaaagacgcgcacgccaaaaggcaaaccgucguaguacuaggaucccaagaaggagccguccacaccgcacucgccggagcacuagaagccgagauggacggcgcaaaaggacgacucuccagcggccaccucaaaugccgacucaaaauggacaaacugcgccuuaaaggcgucucguacuccuuaugcacggccgccuucaccuuuacaaaaauacccgcagagaccguagacggcaccgucaccguagaagggcaguacgggggaaccgauggaccuugcaaaguaccagcccaaauggcaguagacaugcagacccuuacacccguaggacgacuaauaacagccaaccccgucauaaccgaauccaccgaaaacagcaaaaugaugcuagaacuagaucccccauucggcgacucauacaucgugaucggggucggagaaaagaaaauaacccaccacuggcacaggagcgggagcacaaucggcaaagccuucgaagccaccguacggggcgccaaacgaauggccguucucggcgacacagcaugggacuucggcucggucggcggagcacuaaacagccucggaaaaggaauacaccaaauaauaggcgcggccuucaaaucacuauucgggggcaugagcugguucagccaaauacugauagggacgcugcugauguggcucggacugaauacgaaaaacggcuccaucagucuaaugugccuagcccuaggaggcguacugauauuccucagcacagcaguauccggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5180 - RNA, 2275 nt, Artificial Sequence
  KU963574.2 prME-short mRNA Design 1 opt
gggagaaagcuuaccaugggcgccgacgccagcaucggcaucgucucccuacuccuaacaaccguaauggcagcagagauaacgcgacgaggauccgcguacuacauguaccuagacagaagcgacgccggcaaggccaucucauucgucacaacgcuaggcgucaacaaaugccacguucaaauaauggaucucggccacaugugugacgcuaccaugagcuacgaaugcccaaugcucgacgagggcgucgaacccgacgacguggacugcuggugcaacaccaccucaacaugggucguauauggcacgugccaccacaagaaaggcgaagcccgccgaucaaggagagccgucacccucccaagccacucaaccagaaaacuccaaaccagaagccagaccuggcucgagagccgagaauacacaaaacaccugauaaaaguagaaaacuggaucuuccgaaacccaggcuucgcgcuagucgcaguagccauagccuggcuccucggcagcuccacaucacagaagguuauauaccuagucaugauacuccucaucgccccagcauacagcauccgcugcauaggcguaagcaaccgcgacuucgucgaggggauguccggaggaacgugggucgacguagugcuagaacacgguggcugcguaaccgucauggcgcaagacaaaccgaccgucgacaucgagcuagucacaacgacaguaucaaacauggccgaaguacgaagcuacugcuacgaagccagcaucagcgacauggccucagacagcagauguccaacccaaggagaagcauaccucgacaaacaaagcgacacgcaauacgucugcaaacgcacccuaguagaccguggauggggcaacggcugcggccuguuuggaaaaggcucacuggucacaugugccaaauuuacaugcagcaagaaaaugacgggcaaaagcauacaaccagaaaaccuagaauaccgcaucaugcuaagcguccacggaagccaacacuccggaaugauagucaacgacgaaaaccgagcaaaagucgaaguaacacccaacucaccaagagcagaagcaacacucggcggcuucggaagccugggccuagacugcgaacccagaaccggacuagacuucagcgaccuguacuaccucaccaugaacaacaaacacuggcucguccacaaggaaugguuccacgacauaccacuaccauggcacucaggagccgacaccgaaaccccacacuggaacaacaaagaagcacugguggaauuuaaagacgcacacgccaaaagacagaccgucguaguccucgggagccaagaaggcgccguccauacagcacuggccggagcccuagaggccgaaauggacggagcaaaaggacgccuaucauccggccaccucaaaugccgccucaaaauggacaaacuccgacuaaaaggcguauccuacucccugugcaccgccgcauucacauucacaaaaguaccagccgaaacacugcacggcacggugaccguagaaguccaauacgcaggacgcgacggcccaugcaagguccccgcacaaauggcaguagacaugcagacauuaacgccagucggaagacucauaaccgccaaccccgucauaacugaaagcaccgaaaacucaaaaaugaugcuugaacuagacccacccuucggagacuccuauaucgucauaggaguaggcgacaagaaaauaacacaccacuggcacagaucaggcagcauaaucgggaaagccuucgaggccacaguccgcggcgccaaacgcauggcaguccuaggggacacagcaugggacuucggcuccgugggcggaguuuucaacucccuaggaaagggaauccaccaaaucuucggcgccgccuucaaaucacucuucggaggaauguccugguucucucaaauccuaaucggaacccuacucgucuggcucggccuaaacaccaagaacggcagcauaagccuaaccugccucgcgcucggaggcguaaugauauuccucucaacugcggucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5181 - RNA, 2293 nt, Artificial Sequence
  KF383120.1 prME-short mRNA Design 1 opt
gggagaaagcuuaccaugggagcagacaccagcaucggaaucauaggacuacuccuaacaacagcuauggcggccgaaaucacgagaagaggaagcgcauacuauauguaccucgaccguuccgacgcaggcaaagcgauaucauucgcaaccacaaugggcgugaacaaaugccacguccaaaucauggaccuaggucacaugugugacgccaccaugucuuacgaaugccccaugcucgacgaaggagucgaacccgacgacguagacugcuggugcaacaccaccuccacauggguuguguacggaacaugccaucacaagaaaggagaagcccggccgucccgccgcgcaguaacgcucccgagccacuccaccagaaaacuacaaacccgcucacaaacauggcucgaaagucgcgaguacacaaaacaucucauaaaagucgaaaacuggauacuacgcaacccaggcuucacaguggccgcgcucgccauggccuggcuacugggaaacaguacgagccagcgcguaaucuaccucguaaugauucuccugaucgcacccgcauacuccauacgcugcaucggcguuagcaaccgcgacuucguagaaggaauguccggaggaaccuggguagacgugguccuagaacacggaggaugcgucaccgucauggcccaagacaaaccaacagucgacauagagcuaguaacaaccacggucuccaacauggccgaagucagaagcuacugcuacgaagcauccaucagcgacauggcaagcgacucccgcugucccacacaaggggaagccuaccucgacaaacaguccgacacacaauacgucugcaaacgaacccucguggaucgcggauggggcaacggaugcggacucuucggaaaaggaagccuagugaccugugcaaaguucacgugcuccaagaaaaugacaggaaaauccauacaacccgaaaaccucgaauaccggaucaugcucagcguccacggaucccagcacagcggaaugauagugaacgacauaggccacgaaaccgacgaaaaccgagcaaaaguggaagucaccccuaauucaccccgcgcagaagcaacacugggcggcuucggcagccucggccuagacugcgaaccgcgcaccggacuagacuuuucagaccuguacuaucuaacaaugaacaacaaacacuggcuuguccauaaagaaugguuccacgacaucccccucccauggcaugcaggcgcagacacaggcacaccccacuggaacaacaaagaggcacucguggaguucaaagacgcacacgccaaaagacaaaccgucguaguacucggcucccaagaaggagcaguccacaccgcucuggcaggagcauuggaggcagaaauggacggcgcgaagggccgacucuucucaggacaccucaaaugccggauaaaaauggacaaacuaaggcuaaaaggcgucagcuacucacucugcaccgccgcauucacauucagcaaagucccggcagaaacgcuccacggaacagucacgguggaggugcaauacgccggccgagacggacccugcaaaguccccgcccaaauggcaguagacaugcaaacgcucacccccguaggaagacuuaucacggccaacccaauaauaacagaauccaccgaaaacagcagaaugaugcucgagcucgacccucccuucggcgacucauacauaguuaucggaguaggcgacaagaaaaucacgcaccacuggcacaggucaggcagcacaaucggaaaagccuucgaagccaccguccgcggcgcaaaaagaauggccguacucggcgacacagccugggacuuuggaagcgucggcggagucuucaacucacuagggaaaggaguucaccaaguauucggagccgccuucaaaucgcuauucggcgggauguccugguucucgcaaauccucaucggaacccuucuagucuggcucggacugaacaccaaaaacggaagcaucucccuagcaugccuagcccucggcggugcaaugauauuccuaagcacggccguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5182 - RNA, 1576 nt, Artificial Sequence
  KU321639.1 solE mRNA Design 1 opt
gggagaaagcuuaccaugucgcaaaaggucauauaccuggucaugaucuuacucauagccccggcauacagcauaagauguauaggagucucgaacagagacuucgucgaaggaaugagcggaggcacguggguggacauaguccuggaacacggaggaugcgugaccgugauggcgcaagacaaaccgaccguggacauagaacugguaacaaccacggucucgaacauggccgaggucaggagcuacugcuacgaagcaagcauaagcgacauggcaagcgauaguagaugcccgacacaaggcgaggcauaucuagacaaacaaagcgauacccaauacguauguaagcgcacauuaguggaccgaggauggggaaacggcugcggacuguucgggaaaggaagccuagucacgugugcgaaguucgcgugcagcaagaaaaugaccggcaaaucgauacaacccgagaaccuagaauacagaauaaugcuaagcguacacgggagccagcacucgggcaugaucguaaacgacaccggacacgagaccgacgaaaaccgagcgaaaguggaaauaacacccaacucgccccgagcagaggccacccuaggaggauucggcucgcucgggcuagacugcgagcccaggacuggucuagacuucucagacuuguacuaccucacgaugaacaacaagcacuggcuaguacacaaggaaugguuccacgacauaccacugcccuggcacgcgggagccgacacagguacaccccacuggaauaacaaggaggcccucguggaguucaaagacgcccacgcaaaacgccaaaccgugguaguacucggcagccaggaaggggccguccacacggcccuggcaggggcacuggaagcggaaauggacggggcaaagggcagacuaucgagcggacaccuaaaaugucgccuaaaaauggacaagcuaaggcucaagggcguaaguuacagccuaugcacggccgcauucacguucacgaaaauacccgcagaaacgcuacacggcacggucacggucgagguccaauacgcgggcacagacggacccugcaaagugcccgcgcaaauggccguggacaugcaaacgcucacgcccgucggacggcucauaaccgcaaacccgguaauaaccgaaaguacggaaaacagcaaaaugaugcucgaguuagacccaccauucggggacucauacauaguaauaggcgugggcgagaaaaagauaacgcaccacuggcaccgcucgggaucuaccaucggcaaggcuuuugaagcaacaguacgcggggcaaaacgcauggccgugcucggggacacggccugggacuuuggcucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5183 - RNA, 1576 nt, Artificial Sequence
  KU312312.1 solE mRNA Design 1 opt
gggagaaagcuuaccaugucgcaaaaagucaucuaccuagucaugauccuacucauagcccccgccuacagcauccgcugcaucggagucucaaaccgcgacuucguugaaggcaugucaggaggcacaugggucgacgugguacuagaacacggcgggugcgucacagucauggcccaagacaaacccacaguggacaucgaacuggucaccaccacaguaucaaacauggcagaaguuagaagcuacugcuacgaggcaagcauauccgacauggccagcgacucaagaugcccaacacaaggcgaagccuaccuggacaaacaaagcgacacucaauacguaugcaaacgaacgcuaguggacagaggauggggaaacggauguggccucuucggcaaaggcagccucgucacaugcgcaaaauucgccugcucaaagaaaaugaccggaaaauccauucaacccgagaaccuagaauacagaaucaugcuauccgugcacggcagccaacacuccggaaugauagucaacgacaccggccacgaaaccgacgaaaaccgcgcaaaaguggaaauaaccccaaacucacccagagccgaagcaacacuaggcggcuucggcucccucggacuagacugcgaacccagaaccggccucgacuucucagaccuauacuaucuaaccaugaacaacaaacacuggcucgugcacaaagaaugguuccacgacauaccccuacccuggcacgcaggggccgauacaggcacaccccacuggaauaacaaagaagcccucguagaguucaaagaugcacaugcaaaacgacagaccguagucgugcucggcagucaggaaggcgccguccacacggcccuggccggagcccucgaagcagaaauggacggcgcaaaaggccgacucuccagcggacaccuaaaaugccgccuaaaaauggacaaacuacgccucaaaggcgucagcuacagccucugcacagcagcauucacguucacaaaaauaccagcagaaacacuccacggcacaguaacagucgaaguccaguacgccggcacagacggacccugcaaaguaccagcacaaauggcaguagacaugcaaacgcucacgcccguaggacgccuaaucaccgcaaauccagucaucaccgaaagcaccgaaaacagcaaaaugaugcucgaacucgaucccccauucggcgacucguacauagucaucggcgugggagaaaagaaaaucacacaccacuggcaccgcuccggaagcaccauaggcaaagccuucgaagccaccguacgcggagccaaacgcauggcaguacucggagacacagccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5184 - RNA, 1564 nt, Artificial Sequence
  AY632535.2 solE mRNA Design 1 opt
gggagaaagcuuaccaugucgcaaaaaguaauauaccuagucaugauccuacucaucgccccagcuuacagcauacgcugcaucggggucucaaacagggacuucgucgaaggcaugagcggaggaacauggguggacgugguacuagaacacggcggaugcguaaccguaauggcgcaagacaagccuaccguagacaucgaacuaguaaccaccacagucuccaacauggccgaagucaggaguuacugcuacgaagcaagcauaagcgacauggcgagcgacagccggugcccgacacaaggugaagcauaccuagacaaacaaagugacacccaauacgucugcaaaaggacccuaguagacaggggcuggggcaacggcugcggucuauucggaaaaggcagccuagucacaugcgccaaauucaccugcagcaaaaaaaugaccggcaaaucaauccaacccgaaaaccucgaauaccgcauaaugcugagcgugcacgggucacaacacucgggaaugaucggauacgaaacagacgaagaccgcgcaaaaguagaaguaacaccgaacucgccaagagcagaagccacccucggaggauucggcucucucggacucgacugugaaccaagaaccgggcuagacuucucagaccucuacuaccuaacgaugaacaacaaacacuggcucgugcacaaagaaugguuccacgacauaccccugcccuggcacgcaggcgcagacacgggcaccccacacuggaacaacaaggaagcacuaguagaauucaaagacgcccacgccaagcgucaaacaguagucgugcucgggagccaagaaggggccguacacacggcccuagcaggggcccuagaagcagaaauggacggggcaaaaggaagacuauucuccggacaccugaaaugccgccuaaaaauggacaaacucagacuaaagggcguaagcuacagccuaugcacagccgcauucacauucacaaaaguccccgcagaaacacuacacggcaccgucaccgucgaaguccaauacgcgggcacagacggcccauguaaaauaccaguacaaauggcaguagacaugcaaacacucacgccggugggcagacucauaacagcaaacccagucauaaccgaaagcacagaaaacaguaaaaugaugcuugaacucgacccacccuucggugacucguacaucgucauaggaguaggcgacaaaaaaaucacgcaccacuggcaccgaucagggucaaccauuggcaaagcauucgaagcaacaguacgcggggccaaacgcauggccguccuaggggacaccgccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5185 - RNA, 1576 nt, Artificial Sequence
  KU527068.1 solE mRNA Design 1 opt
gggagaaagcuuaccaugucccaaaaaguaauauaccuaguaaugauccuccucaucgcaccggccuauaguauccguugcauaggagucagcaacagagacuuuguagaaggcaugagcggcggcaccugggucgacgucguccuggaacacggaggaugcgugaccguaauggcacaagacaaaccgaccguggacaucgaacuggucacaacaacagucucaaacauggccgaagucagaagcuacugcuacgaagcaagcauaagcgacauggcgagcgacagccgaugcccaacccagggagaagcauaccucgacaaacagagcgacacacaauacguaugcaaacgaacgcucguagacaggggcuggggcaacggaugcggccuauucggaaaagggagccuagucacgugcgcgaaauucgccugcagcaagaaaaugacaggaaaaucaauccagccagaaaaccuagaguaccgaaucaugcugagcguacacgggagccaacacucaggcaugaucguaaacgacaccggacacgaaaccgacgaaaaccgcgcaaaaguagaaauaaccccaaacucaccaagggccgaagcaacgcuaggcggauucggcucacucggacucgacugcgagccaagaaccggacucgacuucagugaccuguacuaccucacaaugaacaacaaacacuggcuaguacacaaagaaugguuccacgacauaccacuccccuggcacgcgggcgcagacacgggcacaccacacuggaacaacaaagaagcccucguagaguucaaagacgcacacgccaaacgacagaccgugguaguacucggaagccaggaaggggccgugcacaccgcccuggccggcgcccuggaagccgaaauggacggagcaaaaggccgccucucaagcgggcacuuaaaaugucgccuaaaaauggacaaacucagguuaaaaggcguaagcuacagucuaugcacggccgcauucacauucaccaaaauaccagcggaaacgcuacacggcacagucacggucgaaguccaauacgcgggcacagacgggcccuguaaaguaccagcacaaauggccguagacaugcaaacacuaacaccggucggccgacucauaaccgcgaacccagucauaaccgaaagcacagaaaacaguaagaugaugcuagaacuagaucccccauucggagacagcuacauagucauaggcguaggugagaaaaagauaacacaccacuggcacagaagcggaucaaccauaggaaaggccuucgaagcaaccgugagaggggcaaaaagaauggccguacucggcgacaccgccugggacuucggcucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5186 - RNA, 1576 nt, Artificial Sequence
  KX421193.1 solE mRNA Design 1 opt
gggagaaagcuuaccaugucgcaaaaaguaaucuaccuagucaugaucuugcuaauagccccggccuacagcauacgcugcaucggaguaucaaacagggacuucgucgaaggaaugagcggaggcacguggguagacgugguacuagaacacggcggaugcgucaccguaauggcgcaagacaaaccaaccguggacaucgaacucguaacgaccacgguaucaaacauggccgaaguaagaagcuacugcuacgaagcaagcaucagcgacauggcaagcgauagccggugcccgacccaaggagaagcauaccuagacaaacagagcgacacccaauacguaugcaaacgaacccuaguagacaggggcuggggcaacggcugcggacuauucggaaaagggagccuagucacaugcgccaaauucacaugcagcaagaaaaugaccgggaaaucaauccagcccgaaaaccuagaauaccgcauaaugcuaagcgugcacgggagucagcacucuggcaugaucgugaacgacacgggauacgaaacagacgaaaacagagcaaaaguagaaguaacaccaaacuccccaagagccgaagccacgcucgggggauucggaucgcucggacuagacugcgaaccccguaccgggcuagacuucucagaccuauacuaccuaacaaugaacaacaaacacuggcucguacacaaagaaugguuccacgacauaccacugcccuggcacgcgggcgccgacacuggaacaccacacuggaacaacaaagaagcccuaguagaguucaaagacgcacaugcaaagagacagaccguggucguacugggaagccaagaaggagcaguacacacagcacuagcaggggcacuagaagcggaaauggacggggccaaaggaaaacuauucaguggacacuuaaagugcagacuaaaaauggacaaacuaagacucaagggcguaagcuacagccuaugcacagcagcguucacguucacgaaagugccagcggaaacgcuacacggaaccgucacugucgaaguccaauacgcgggcacagacgggcccugcaaaauccccguccaaauggccguagacaugcaaacgcuaacacccgugggaagacuaauaaccgcaaacccagucauaacagaaagcacggaaaauagcaaaaugaugcucgaacuagacccaccguucggagacagcuacauaguaauaggcguaggagacaagaaaaucacccaccacuggcaccgcucgggcucaaccauaggaaaagccuucgaagcgaccguacgcggagccaaacgaauggccguacuaggagacacggcaugggacuucggcucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5187 - RNA, 1576 nt, Artificial Sequence
  LC002520.1 solE mRNA Design 1 opt
gggagaaagcuuaccaugucacagaaaguaauauaccuaguaaugauacuccucauagccccggccuacuccauacgcugcaucggagucagcaacagagacuucguagagggaaugagcggcggaacauggguagacgugguccuagaacacggcggaugcguaacaguaauggcacaagacaaaccaaccguggacauagaauuggucacaaccacaguaucgaacauggccgaagucagaaguuacugcuacgaagcaagcauaagcgacauggcaagcgacagccgcugccccacccaaggagaggcauaccucgacaaacaaagcgacacacaauacguaugcaaacgaacacucguagaccggggcugggguaacggcugcggccuauucgggaaagggagccuagucacaugcgcgaaguucacaugcagcaagaaaaugaccggcaaaagcauccagcccgagaaccuagaauacagaauaaugcucagcgugcacgggagccaacacucgggcaugaccguaaacgacaucggcuacgaaacagacgaaaaccgcgccaaaguagaaguaaccccgaacucgccaagagccgaagccacccuagguggauucggaucccucggacucgacugcgaaccaagaaccggacucgacuucucggaccuauacuaccucacgaugaacaacaaacacuggcuaguacacaaagaaugguuccacgacauaccccuacccuggcacgccggagcagacacaggcacgccacacuggaacaacaaagaagcgcuaguagaguucaaagacgcccacgccaaacgacaaacagugguaguguuaggaagccaagaaggggcaguccacacagcccuggcaggagcacucgaagcagaaauggacggagccaaaggcaaacucuuuagcggacaccucaaaugccgccuaaaaauggacaaacuccgccuaaagggcguaaguuacagccugugcacggcagcguucaccuucacaaaagugcccgcggaaacacuccacggcaccgucacggucgaaguccaauacgcaggaacggacggacccugcaagauacccguacaaauggcaguagauaugcagacucucacccccgucggaagacucauaaccgccaacccgguaauaacagaaagcacagaaaacagcaaaaugaugcucgaacucgacccaccauucggggacucauacauagugaucggcgugggcgacaagaaaaucacccaccacuggcaucgcucgggcagcaccauaggcaaagccuucgaagcaacaguccgcggggcaaaacgaauggccguauuaggggacaccgcaugggacuucggcucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5188 - RNA, 1558 nt, Artificial Sequence
  DQ859059.1 solE mRNA Design 1 opt
gggagaaagcuuaccaugucccaaaaggucauauaccuuguaaugauccuacucauagcuccagcauacagcauacgcugcauaggcguaucaaacagagacuucguagaaggcaugagcggaggaacaugggucgacguaguacucgaacacggaggcugcgucacaguaauggcacaggacaaaccgaccguggacauagaacucgucacaaccacagucuccaacauggccgaaguaagaagcuacugcuacgaagcaagcaucagcgacauggcgucagacagccgaugcccaacacaaggcgaagccuaccuggacaaacagagugacacccaguacgugugcaaacggacacuuguagacagaggcuggggcaacggcuguggccuguucggaaaagggagccuagugaccugcgcaaaauucacaugcagcaagaaaaugacaggcaaaucaauccaaccagaaaaccucgaauacagaauaauguuauccguccacggaagccaacacuccggcaugauaguaaacgacgaaaaccgcgccaaaguagaaguaacaccaaacucacccagagccgaagccacgcucggcggcuucggaucgcuaggccuagacugcgaaccccgaacagggcucgacuucagcgaccucuacuaccucacgaugaacaacaaacacuggcuaguacacaaagaaugguuccacgacaucccccuacccuggcacgcaggcgcagauacaggcacaccgcacuggaacaacaaggaagcgcucguggaguucaaagacgcacacgccaagagacaaaccguagucguacuaggaagucaggaaggcgccguacacaccgcccucgccggagcacucgaagcagaaauggacggagcaaaaggaagacucuucagcggacaccucaaaugccgccucaaaauggacaagcuaagacucaaaggcguaagcuacagccuaugcacagccgccuucacauucacaaaaguacccgccgaaacacuccacggcacagucaccgucgaaguccaauacgccggcacagacggacccugcaaaguacccgcacaaauggccgucgacaugcaaacgcucacacccgucggcaggcucauaaccgcaaacccggucaucaccgaauccacggaaaacaguaaaaugaugcucgaacuagaucccccauucggcgacucguacauaguaauaggcgucggcgacaagaaaauuacacaccacuggcaccgauccggaagcaccauaggcaaagccuucgaagcaacaguccgcggcgccaaacgcauggccguacuaggggacacggcaugggacuuuggcucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5189 - RNA, 1564 nt, Artificial Sequence
  KU963573.2 solE mRNA Design 1 opt
gggagaaagcuuaccaugucacaaaaagucauauaccuaguaaugauacugcuaauagcaccagcauauagcauacgcugcaucggagucuccaacagagacuucgucgagggcaugagcgggggaacguggguggacguaguacucgaacacggcggaugcgucaccgucauggcacaagacaaaccaacaguagacauagaacuggucacaaccaccgucucaaauauggccgaagucagauccuacugcuacgaagcaagcaucuccgacauggcaagcgacagccgaugcccaacccaaggcgaagccuaccucgacaaacaaucagacacgcaauacguuugcaaacgaacccucgucgaccgaggcuggggcaacggcugcggccucuuugggaaaggaagccuaguaacaugcgcgaaauucacaugcuccaagaaaaugaccggcaaaucaauccaaccagagaaccuagaauaccgaaucaugcugagcguacacggcagccaacacucaggaaugauaggguacgaaaccgacgaaaaucgagccaaagucgaagucaccccaaacagcccacgagccgaagccacccucggaggcuucggaucacucggacucgacugcgaaccccggaccgggcucgacuucucagaccuguacuaccucacaaugaacaauaaacacuggcucguacauaaagaaugguuucacgacauaccccuccccuggcacgccggcgcagacaccggcacaccacacuggaacaacaaagaagcacucguggaguucaaagacgcccacgccaaacgccagaccgucgucguacuaggcucacaagaaggagcaguccacacagcccuagcaggggccuuagaagcggaaauggacggcgcaaaagggaaacucuucagcggacaccugaaaugccgccuaaaaauggacaaacuacgacucaaaggcguaagcuacagucuaugcacggccgcauucaccuucaccaaagucccagcagaaacacuccacggcacagucacaguagagguucaauacgcaggcacagacggccccugcaaaauacccguccaaauggccguagacaugcaaacccuaacccccgucggcagacuaaucacagccaacccggucaucacagaauccacagaaaacagcaaaaugaugcucgaacucgacccaccauucggagacucuuacauagucauaggaguaggcgacaagaaaaucacgcaccacuggcaccgauccggcuccacaauaggcaaagccuucgaagcaaccgugcgcggcgcaaaaagaauggcaguccucggagacaccgccugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5190 - RNA, 1576 nt, Artificial Sequence
  KY075939.1 solE mRNA Design 1 opt
gggagaaagcuuaccaugucgcagaaagucauauaccuggucaugauccugcucauagccccagccuacagucuacgaugcaucggaguaagcaacagagacuucgucgaaggaaugaguggaggcacauggguggacgucguccuggaacacggcgggugcgucacaguaauggcacaagacaaacccaccguagacaucgagcuagucacaaccacagucuccaacauggccgaagucagaagcuacugcuacgaagcaagcauaucagacauggcaagcgacagcagaugcccgacccagggggaggccuaccucgacaaacaaagcgacacccaauacgucugcaaacgcacccuaguggacaggggcuggggcaauggcugcggccuguucggaaaaggcagccuggucacaugcgcaaaauucgccugcucaaagaaaaugacaggaaaaagcauccaacccgaaaaccuggaauaucgcauaaugcuaucaguccacggcagccagcacucaggcaugauagugaacgacaccggacacgaaacagacgaaaaccgcgcaaaaguagaaauaaccccaaacucaccccgagccgaagcaacgcuuggcggcuucggaucacuuggacucgacugcgaaccaagaaccggacuagacuucagugaccucuacuaccucaccaugaacaacaaacacuggcucgugcacaaagaaugguuccacgacauaccauuacccuggcacgcgggcgcagacacuggaacaccccacuggaacaacaaagaagcgcucguggaguucaaagaugcccacgccaaacgccagaccguggucguacucgggagccaggaaggagcaguacacacggcccuagcaggggcccuagaagcagaaauggacggagcaaaaggcagacucucaagcggacacuuaaaaugccgccugaaaauggacaaacuacggcuaaaaggaguaaguuacagccucugcacagccgcauucacguucacgaagauaccggccgaaacacuccacggaacagucacgguagaaguccaauacgcgggcacggacgggccaugcaaaguacccgcgcaaauggcaguagacaugcaaacgcuaacacccgugggccgacucauaacagcaaaccccgucauaaccgaaagcaccgaaaacagcaaaaugaugcucgaacucgaucccccguucggagacucauacauaguaauaggcguaggagaaaagaaaaucacgcaccacuggcaccgcucaggaucaaccauaggcaaagccuucgaagccacaguaagaggggccaaacgcauggcagugcuaggcgacacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5191 - RNA, 1576 nt, Artificial Sequence
  KX447516.1 solE mRNA Design 1 opt
gggagaaagcuuaccaugagcaaaaaagucauauaccucgucaugauccuccuuauagcccccgccuacucaauccgcugcaucgguguaagcaaccgcgacuucguugaaggaauguccggcggaaccugggucgacgucguccucgaacacggcggcugcgugacugucauggcacaagacaaacccaccguagacaucgaacucgucacaaccaccgucucgaacauggccgagguacggagcuacugcuacgaagcauccauaucagacauggccuccgacuccagaugcccaacucaaggagaagccuaccucgacaaacaauccgacacccaauacguaugcaaacgaacccuaguggaccgaggauggggcaacggcugcggacucuucggcaaaggcucccucgugacaugcgccaaauucgccugcucaaaaaaaaugaccggaaaauccauccaacccgaaaaccucgaauacaggaucaugcuaagcguccacggaucacaacacuccggaaugaucgucaacgacacaggacacgaaacagacgaaaaccgagcaaaaguagaaauaacaccaaacucccccagagccgaagccacccucggcggcuucggcucccuaggccuagacugcgaaccaagaacgggccucgacuucuccgaccucuacuaccucaccaugaacaacaaacacuggcucguacacaaagaaugguuccacgauaucccccuccccuggcacgccggcgccgacaccgggaccccccacuggaacaacaaagaagccuuagucgaauucaaagacgcacacgcaaaaagacaaaccgucgucguccucggaagccaagaaggcgcaguccacacagcccucgcgggagcccuagaagcagaaauggacggagcgaaaggccgccucuccagcggccaccucaaaugccgccucaaaauggacaaacuaagacugaaaggcgucuccuacucccucuguaccgcagcauucaccuucacaaaaauccccgcagaaacccuccacggcaccgucaccguagaaguccaauacgcaggcacggacggccccugcaaaguaccagcccaaauggccguagacaugcaaacccuaacccccgucggccgacucauaaccgcaaauccagucaucacagaaucgaccgaaaacagcaaaaugaugcucgaacuugaccccccauucggggacuccuacauaguaaucggcgucggcgaaaaaaagauaacccaccacuggcaccgcucuggaucuaccaucggcaaagccuucgaagccaccguacgcggagcaaaacgcauggccguccucggcgacaccgcaugggacuucggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5192 - RNA, 1576 nt, Artificial Sequence
  KX447515.1 solE mRNA Design 1 opt
gggagaaagcuuaccaugucacaaaaaguaaucuaccuggucaugauccuacucauagcccccgcauacagcauacgcugcauaggagucucaaaccgcgacuucgucgaaggaaugagcgggggaacguggguagacguaguccuagaacacggcggaugcguaaccguaauggcgcaagacaaaccaaccguagacauagagcuagucacaacaacagucucgaacauggcagaagucaggagcuacugcuacgaagcaaguauaagcgacauggccagcgauucccgaugcccgacacaaggagaagcauaccuagacaaacaaagcgacacacaauacguaugcaaacgcacccuaguagaccguggcuggggcaacgguugcggacuauucgggaaaggaagucuggucacaugcgcaaaauucgcaugcagcaagaaaaugaccggaaaaucgauacagcccgaaaaccuagaauaccgaauaaugcuaagcguacacgggagccaacacucgggaaugauaguaaacgacaccggacacgagaccgacgaaaacagagcaaaaguagaaauaacaccaaacucgccucgagccgaagcaacacucggaggcuucggaucacucggacucgacugcgagcccagaaccggccucgacuucucggaccuauacuaccucacaaugaacaacaaacacuggcucguacacaaagaaugguuccacgacauaccccugcccuggcacgcaggcgccgacacgggaacgccccacuggaacaacaaagaagcccuaguagaguucaaagacgcacacgccaaacgccaaaccguggucgugcucgggagccaagaaggagcagugcacacagcacuggccggagcccuggaagccgaaauggacggagcaaaaggaaggcucucaagcggacaccuaaaaugccgccugaaaauggacaaguuaaggcuaaaaggaguaucauacagccucugcacggccgcguucaccuucacaaaaauacccgcagaaacgcuacacggcaccgucacagucgaaguacaguacgcgggaaccgacggcccaugcaaaguacccgcacaaauggccguggacaugcaaacacuaacgccagugggcaggcuaauaaccgcaaacccagucauaacggaaagcacggaaaauagcaaaaugaugcucgaacucgacccaccguucggagacucguacauaguaauaggcguaggcgaaaagaaaauaacacaccacugguaccgcucgggcucaaccauaggcaaagcauucgaagcaaccgugcgaggcgccaaacgcauggcuguacucggagacacagcaugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5193 - RNA, 1576 nt, Artificial Sequence
  KU758874.1 solE mRNA Design 1 opt
gggagaaagcuuaccaugagccaaaaagucauauaccuagucaugauccuacuaaucgccccagcauacucaauacgcugcaucggcgucagcaaucgagacuucgucgaaggcaugagcggcggcacaugggucgacguaguccucgaacacggcggcugcgucaccgucauggcccaagacaaaccaaccguagacauagaacucgucacaacaacagucucaaacauggccgaagucagaagcuacugcuacgaagccuccauaagcgacauggcauccgacucacgcugcccaacacaaggcgaagcauaccucgacaaacaguccgacacgcaauacguaugcaaacgcacccuaguagacaggggcugggggaacggaugcggcuuauucggcaaaggcagccucgucacaugcgcgaaauucgccugcuccaagaaaaugaccggcaaauccauacagccagagaaccuagaauaccgaauaaugcucuccguccacggaucacaacacagcggaaugaucguaaacgacaccggccacgagaccgacgaaaaccgcgccaaagucgaaaucacccccaacagcccacgagccgaggccacacucggaggcuucggcucgcuaggacucgacugugaaccuagaaccggccucgacuucucagaccucuacuaccuaacgaugaacaacaaacacuggcuagugcacaaagaaugguuccacgacauaccacugcccuggcacgcaggcgcagacaccggcacgccacacuggaacaacaaggaagcccuaguagaguucaaagacgcccacgccaagcgacaaaccgucguagugcucggcucccaagaaggagccguccacacagcucuagccggagcacuagaagcagaaauggacggagccaaaggaaaacucucaagcggccaccuaaaaugccgacucaaaauggacaaauuacgacuaaaaggcguauccuacucccuaugcacagccgcauucacauucacaaaaauucccgccgaaacgcuacacggcacagucacaguggaaguacaauacgccggcacagacggaccaugcaaaguaccagcccaaauggccgucgacaugcaaacgcugacacccgucggcagacucauaacagccaaccccgucauaaccgaaaguaccgaaaacucaaaaaugaugcucgaacucgacccaccauucggagacagcuacauagucaucggcgucggagaaaagaaaauaacccaccacuggcaccgaagcggcuccacaaucggaaaagccuucgaagccacaguacggggagccaaacguauggccguacucggcgauaccgcaugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5194 - RNA, 1576 nt, Artificial Sequence
  KU729218.1 solE mRNA Design 1 opt
gggagaaagcuuaccaugucacaaaaagucauauaucuagucaugauccugcuaauagccccagccuacagcauccgcugcaucggaguaucgaaccgcgacuucgucgaaggcaugagcggaggcaccuggguagacguaguccuagaacacggcggaugcguuaccguaauggcacaagacaagccaaccguagacaucgagcuagucaccaccaccguuuccaacauggcagaaguacgaagcuacugcuacgaagcaaguauaagcgacauggcguccgacagccggugccccacacaaggcgaagccuaccucgacaaacaaagcgacacacaguacguuugcaagcggacgcugguggaccgcggcuggggcaacggaugcggauuguucggaaaaggaagccuagucacaugcgcgaaauucgcaugcagcaagaaaaugacaggcaaaucaauacagccagaaaaccuagaauacagaauaaugcuaagcguacacggaagucaacacagcggcaugaucgucaacgacacaggccacgagaccgacgaaaacagagcaaaaguagaaauaaccccaaacucgccaagagccgaagccacacucggaggauucggcucgcucggacucgacugcgagcccagaaccggacucgacuucuccgaccuauacuaccucacaaugaacaauaaacacugguuaguacacaaagaaugguuccacgacaucccacugcccuggcacgcaggagccgacacaggcacaccccacuggaacaacaaggaagcucuaguagaguucaaagacgcccacgcgaaacgucaaaccguaguaguacuaggcagccaagaaggcgcagugcacacagcccucgccggcgcacuagaagcggaaauggacggcgcaaaaggcagauuaagcagcggccaccuaaaaugccgccuaaagauggacaaacuaagacucaaaggaguaagcuacagccuaugcacagcagcauucaccuucaccaaaauacccgccgaaacacuacacgggacaguaacagucgaaguacaguaugcaggcacagacggccccugcaaaguacccgcacaaauggccguggacacccaaacacuaacccccguaggcaggcuaauaaccgccaacccaguaaucaccgaaagcacagaaaacagcaaaaugaugcucgaacuagaucccccauucggagacuccuacaucgucauaggagucggcgaaaagaaaaucacucaucacuggcaccgaucaggcuccaccaucggcaaagcauucgaagcaaccguacgcggcgccaaacguauggccgugcuaggcgacacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5195 - RNA, 1576 nt, Artificial Sequence
  KU501217.1 solE mRNA Design 1 opt
gggagaaagcuuaccaugucacaaaaagucauauacuuagucaugauacuacucauugcccccgcauacuccauacgaugcaucggcgucuccaacagagacuucguagaaggcaugagcggcggcacaugggucgacguaguccuggaacacggcggcugcguaaccgugauggcccaagacaaaccaacuguagacauagaacucgucacaaccaccguaagcaacauggccgaaauccgaagcuacugcuacgaagccagcauaagcgacauggcguccgacagccgcugcccaacccaaggcgaagccuaccuagacaaacagagcgacacacaauacgucugcaaacgcacacuaguagacagaggcuggggaaacggcugcggacuauucggaaaaggaagccuaguaacgugcgcgaaauucgccugcagcaaaaaaaugacaggaaaaucaauccagcccgagaaccuagaauacagaauuaugcuaagcguacacgggucccaacacucaggaaugauaguaaacgacacuggccacgaaaccgacgaaaacagagccaaaguagaaauaacacccaacucaccccgagccgaagccacacuaggaggcuucggcucacucggacucgacugcgaaccaagaaccggacuagacuucucggaccucuacuaccucacgaugaauaacaaacacuggcucguccacaaagaaugguuccacgacauaccccucccuuggcacgcuggcgcagacaccggaacaccacacuggaacaacaaggaagcacucgucgaauucaaagacgcccacgccaaacgccaaaccguagucguacucggaucccaagaaggggcaguacacacagcccuggccggagcacucgaagcagaaauggacggcgccaaaggacgacuaucuaguggccaccugaaaugucgccuaaaaauggacaaacuccgacucaaaggcguaagcuacagccucugcaccgcagccuucaccuucaccaaaauaccagcagaaacacuacacggcacgguaaccgucgaaguccaguacgcaggaacugacgggcccugcaaagucccagcccaaauggcagucgacaugcaaacccuuacccccguaggacgccucauaacagccaacccagucaucaccgaaagcacagaaaacagcaaaaugaugcucgaacucgacccacccuucggagacucauacauagucauuggcgugggcgaaaaaaaaauaacucaccacuggcaccgaucgggcucaacuauaggcaaagccuucgaagcgaccguccgcggcgccaaacgcauggccguacucggcgacacagccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5196 - RNA, 1576 nt, Artificial Sequence
  KU761561.1 solE mRNA Design 1 opt
gggagaaagcuuaccaugagccaaaaaguaauauaccucgucaugauccugcucauagcccccgcuuacuccauacgcugcaucggcgucagcaacagggacuucguagaaggcaugucaggcggcacauggguagacguaguccuagaacacgggggaugcgucaccguaauggcccaagacaaaccaacaguagacaucgaacucgucacgacgaccgucuccaacauggccgaaguacgcagcuacugcuacgaagcaagcauaucagacauggcauccgacucccgcugccccacccaaggcgaagccuaccucgacaaacaauccgacacccaauacguaugcaaacgaacccuaguagaccgaggcuggggaaacggcugcggacuauucggaaaaggcucacucguaacaugcgcaaaauucgccugcagcaagaaaaugaccggaaaauccauccaacccgaaaaccucgaauaccgcauaaugcucuccguccacggaagccaacacucgggcaugaucguaaacgacaccggccacgaaaccgacgaaaaccgcgcaaaaguagaaauaacacccaacagccccagagcagaagcaacccucggcggcuuuggaucccucggacuagacugcgaaccccgaaccggccucgacuucagcgaucuauacuaccucacaaugaacaacaaacacuggcuaguccacaaagaaugguuccacgacauaccucugcccuggcacgccggugcagacacaggcaccccgcacuggaacaacaaagaagcccuagucgaguucaaagacgcccacgccaaacgccaaacagucgucguccuaggcagccaagaaggcgcaguccacaccgcccuagcaggagcccuagaagcagaaauggacggagcaaaaggaagauuaucauccggccaccugaaaugucgccuaaaaauggacaaacuccgacucaaaggggucagcuacagccucugcacggccgcauucacauucacaaaaaucccagcagaaacacuccacggaaccgucacaguagaaguccaauacgcaggcaccgacggccccugcaaaguaccagcacaaauggccguagacaugcaaacccuaacccccgucggacgccuuaucaccgcaaacccaguaaucacggaaucaaccgaaaacagcaaaaugaugcuagaacucgacccgcccuucggcgacagcuacauaguuauaggcguaggagaaaagaaaauaacccaccacuggcaucgcagcgguucaaccaucggaaaagccuucgaggccaccguacgcggcgcacgccgcauggccguacucggcgacacggccugggacuucggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5197 - RNA, 1576 nt, Artificial Sequence
  KY075937.1 solE mRNA Design 1 opt
gggagaaagcuuaccaugagccaaaaaguaauauaccuagucaugauacuacucaucgcacccgccuacucaauccgcugcauaggcgucucaaaccgagacuucgucgaaggcaugagcggaggaacgugggucgacguaguacucgaacacggcggaugcgugaccguuauggcacaagacaaaccaaccgucgacauagaacucgucacaacaacggucucaaacauggccgaaguccgcucauacugcuacgaagcauccauaagcgacaugguaucugacucacgcugcccaacccagggagaagcguaccuagacaaacaaagcgacacccaauacgucugcaaaagaacccuaguggaccgcggauggggaaacggcugcggccuauucggcaaaggaagccuaguaacaugcgccaaauucgccugcagcaagaaaaugaccggcaaaucaauacagcccgaaaaccuagaauacagaauaaugcuaagcguccacggcucacaacacuccggaaugaucguaaacgacaccggacaugaaaccgacgaaaaccgagcaaaagucgaaaucaccccaaacucacccagagccgaagccacccuaggaggauucggcagccuaggccuagacugcgaaccacgaaccggacucgacuucuccgaccucuacuaccuaacaaugaacaacaaacacuggcucguccacaaagaaugguuccacgacaucccccuccccuggcacgcaggagcagacaccggcacaccccacuggaacaacaaagaagcgcucgucgaguucaaagacgcacacgccaaacgccaaaccgucgucguacuaggaagucaagaaggcgccguacacaccgcacucgcaggcgcacuagaagcagaaauggacggagccaaaggccgacucagcagcggacaccucaaaugccgacuaaaaauggacaagcuacgccucaaaggagucuccuacagccuaugcacagcagcguuuacauucacgaaaaucccagcagaaacccuccacggcacagucacggucgaaguacaauacgcaggcacagacggacccugcaaaguccccgcgcaaauggccguagacaugcaaacccugaccccaguaggccgccuuaucaccgccaacccagucaucaccgaauccacagaaaacuccaaaaugaugcucgaacuagaucccccguucggagacuccuacauaguaauaggcguaggagaaaagaaaaucacccaccacuggcacagaucgggcuccacaaucggcaaagcauucgaagcaaccguccgaggcgccaaacgcauggccguacucggagacacggcaugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5198 - RNA, 1576 nt, Artificial Sequence
  KY014317.1 solE mRNA Design 1 opt
gggagaaagcuuaccaugagccaaaaaguaauauaccucgucaugauccuucucaucgcaccagcauauuccauacgcugcauuggaguaucaaacagagacuucgucgaaggaaugagcggaggcacguggguggacgugguccuagaacacgggggcugcguaaccguaauggcucaagacaaaccgacaguagacaucgagcuagucaccaccaccgucucaaacauggcagaagucagaaguuacugcuacgaagccagcauaagcgacauggcaagcgacagcagaugccccacccaaggcgaggcauaccucgacaaacaaagcgacacccaauacguaugcaaacgcacacucguagaccgcggcuggggcaacggcugcggacuauucggcaaaggaagccucgucacaugcgccaaauucgcaugcucaaagaaaaugaccggcaaaagcauacagcccgagaaccuggaauaccgaauaaugcucagcguacacggaucacaacacucaggcaugaucgugaacgacacagggcaugaaaccgacgaaaaccgcgccaaaguagaaaucaccccgaacuccccaagagccgaagccacacucggcggcuucggcucacuaggacucgacugcgagccaagaaccggccuagacuucucagaccuuuacuaccucacaaugaauaacaaacacuggcucguccacaaagaaugguuccacgacauaccccuccccuggcacgcaggcgcagauacaggaacgccccacuggaacaacaaggaagcacuuguagaguucaaagacgcacacgccaaacgacaaaccguagucguacucggaagccaagaaggagccgugcacaccgcccuagcaggagcccucgaagccgaaauggacggagccaaaggcagacuaucaagcggacaccuaaaaugccgccuaaaaauggacaaacuacgacucaagggcguauccuacagccuaugcaccgcugcauuuaccuuuacaaaaauacccgccgaaacacuacacggcacaguaacagucgaaguccaguacgcaggcacagacgggcccugcaaaguaccagcacaaauggcaguagacaugcaaacgcuaacgcccguaggacgccucaucacagccaacccagucaucaccgaaagcauagaaaacagcaaaaugaugcuagaacuagaucccccauucggagacucauacauagucaucggcguaggagaaaagaaaaucacgcaccacuggcaccgcucaggaucaaccaucggcaaagccuuugaagcaacagugcgaggcgccaaacgcauggccguacucggagacacagccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5199 - RNA, 1576 nt, Artificial Sequence
  KU870645.1 solE mRNA Design 1 opt
gggagaaagcuuaccaugucgcaaaaaguaauauaccuagucaugauacugcucauagcaccagccuacaguauacgaugcaucggcgucagcaacagggacuucgucgaaggcaugagcggaggcacauggguugacgugguacuagaacacggcggaugcguaaccgugauggcacaagauaaaccaacgguagacaucgaacugguaacaacaacaguaagcaacauggccgaaguaaggagcuacugcuacgaagcaagcauaagcgacauggcaagcgacuccagaugcccaacacaaggcgaagccuaccucgacaaacaaagcgacacccaauacgucugcaaacgcacacucguagauagaggcuggggaaauggcugcggccuauucggaaaaggaagccucgucacgugcgcaaaauucgccugcagcaagaaaaugaccggcaaaucgauccaaccagaaaacuuagaauaucgaaucaugcugagcguacacgggagccaacacuccggaaugauagugaacgacacaggacacgaaaccgacgagaacagggcaaaaguagaaaucacaccaaacucaccccgggccgaagccacacucggaggauucggaagccucggacuagacugcgaaccaagaacaggacucgacuucagugaccuauacuaccucacaaugaacaacaaacacuggcucguacacaaagaaugguuccacgacaucccacugccauggcacgcgggcgcagacacaggcacaccccacuggaacaacaaagaagcccuaguagaguucaaagacgcacacgccaaacgccaaaccguagucguacuaggaagccaagaaggggccguacacacagcccuggccggggcacucgaagcagaaauggacggagcaaaaggcaggcucucgucaggacaucuaaaaugccgccuaaaaauggacaaacucaggcucaaaggcgugagcuacagccuguguacagcagcauucacauucacaaaaauacccgcagaaacacuccacggcacagucacgguagaaguacaauacgcaggcacagacggcccaugcaaaguacccgcgcagauggccgucgacaugcaaacacuaacacccguaggacgacuaauaaccgcaaacccggucauaaccgaaagcacggaaaauagcaaaaugaugcucgaacuagacccaccauucggcgauucauacaucgucaucggcauaggcgaaaagaaaaucacacaccacuggcaccgcucaggcucaacaauaggcaaagccuuugaagcaaccguacgcggggcaaaacgcauggcagugcuaggggacacagcaugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5200 - RNA, 1576 nt, Artificial Sequence
  KU922923.1 solE mRNA Design 1 opt
gggagaaagcuuaccaugucacagaaagucaucuaccuagucaugauccuccuaaucgcacucgccuacucaauacgcugcauaggagucuccaaccgagacuucguagaaggaauguccggcggaaccuggguagacguaguccucgaacacgggggcugcguaacagucauggcccaagacaaacccaccgucgacauagaacucguaaccaccaccgucucaaacauggccgaaguccgaucguacugcuacgaagccagcaucuccgacauggccuccgacucccgaugcccaacccagggagaagccuaccuagacaaacaaagcgacacacaauacguaugcaaacgaacacucgucgaccgcggcuggggaaacgguugcggacuauucggcaaaggaagccuagucacaugcgcaaaauucgcaugcucaaagaaaaugaccggcaaauccauccaaccagaaaaccucgaauaccgaauaaugcucagcguccacggcucacaacacagcggaaugauaguaaacgacaccggacacgaaaccgacgaaaaccgcgcaaaagucgaaaucacccccaacuccccacgcgccgaagccacccuaggaggauucggaucccucggacuagacugcgaacccagaaccggccucgacuucuccgaccucuacuaccucaccaugaacaacaaacacugguuaguccacaaagaaugguuccacgacaucccccuccccuggcacgccggcgccgacacaggaaccccgcacuggaacaacaaagaagcccucgucgaguucaaagacgcgcacgccaaacgacaaaccgucgucguacuagggucccaagaaggagccguacacacagcacuagccggcgcccuugaagcagaaauggacggcgcuaaaggccgacucagcuccggacaccucaaaugcagacuuaaaauggacaaacuccgccucaaaggcgucagcuacagccucugcaccgccgcauucacauucacaaaaauacccgccgaaacccuccacggcaccgucacaguagaaguccaauacgccggaaccgacggccccugcaaaguaccagcccaaauggcagucgacaugcaaacacuaaccccagucggacgacuuaucacggcaaaccccgucaucacagaaucaaccgaaaacuccaaaaugaugcucgaacucgacccaccuuucggcgacuccuacaucguaaucggaguaggcgaaaagaaaaucacacaccacuggcaccgauccggauccacgaucggcaaagccuucgaagcaacaguccgcggagcaaaaagaauggccguacucggagauaccgccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5201 - RNA, 1576 nt, Artificial Sequence
  KU497555.1 solE mRNA Design 1 opt
gggagaaagcuuaccaugagccaaaaagucauauaccuagucaugauccuccucauagccccagcauacuccauacgcugcaucggaguaagcaaccgagacuucgucgaaggaaugucaggcggaaccugggucgacgucguacuagaacacggcggaugcguaacaguaauggcccaagacaaaccaacaguagacaucgaacucguaacaaccacagucagcaacauggcagaaguaagauccuacugcuacgaagccucaauaagcgacauggcauccgacuccaggugcccaacacaaggcgaagccuaccucgacaaacaaagcgacacacaauacgucugcaaaagaacacuuguagacagaggauggggcaacggaugcggccucuucggaaaaggaagccucguaaccugcgccaaauucgccugcagcaaaaagaugacaggaaaaucgauccaacccgaaaaccuagaauaccgcaucaugcucuccguccacggcagccagcacucaggcaugauagucaacgacacaggacacgaaacagacgaaaaccgagccaagguagaaauaaccccaaacagcccccgagccgaagcaacccucggaggauucggaucacuaggacuagacugcgaaccccgaaccggccucgacuucuccgaccuauacuaccuaaccaugaacaacaaacacuggcucguccauaaggaaugguuccacgacauaccccugcccuggcacgcgggcgcagacacgggcacaccccacuggaacaacaaagaagcccucgucgaguucaaagacgcccacgcaaaacgccagaccguagucguacuaggcacccaagaaggagccguccacaccgcccuggccggagcccucgaagccgaaauggacggagcaaaagggcgacucagcagcggccaccuaaaaugccgccuaaaaauggacaaacuaagacuaaaaggcguaucauacagccuaugcacagcagcauucaccuucaccaaaaucccugcagaaacacuccacggcaccgucacggucgaaguccaguacgccggcacagacggacccugcaaagucccagcccaaauggccgucgacaugcaaacccuaacacccgucggaagacuaauaaccgccaaccccguaaucaccgaaagcacagaaaauucaaaaaugaugcucgaacuagaucccccguucggagacuccuacauaguuaucggcguaggcgagaaaaagaucacacaccacuggcacagauccggcagcacaauaggaaaggccuucgaagcaacaguccgcggagcaaaacgaauggcaguccucggagacacagccugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5202 - RNA, 1576 nt, Artificial Sequence
  KU312314.1 solE mRNA Design 1 opt
gggagaaagcuuaccaugucgcaaaaagucaucuaccuagucaugauccuccuaauagccccggccuacaguauacgaugcaucggcgucagcaacagggacuucgucgaaggcaugagcgggggcacguggguagacguaguuuuagaacacggcggaugcguaaccgugauggcacaagacaagccaaccguagacauagagcuagucacaaccacaguuucaaacauggcagaagucaggagcuacugcuacgaagcgagcauaagcgacauggcgagcgacagcagaugcccaacucaaggcgaagccuaccuugacaaacaaagcgacacccaguacguaugcaaaagaacccuagucgaccgaggaugggggaacgguugcggacuauucggaaaagggagccuagucacaugcgcgaaauucgccugcagcaaaaagaugacaggaaaaagcauccaacccgagaaccuagaauaucgaauaaugcucagcguacacgggagccaacacucaggaaugauagucaacgacacagggcacgaaaccgacgaaaaccgagcgaaaguggagauaacuccaaacucacccagagcugaggcaacacuaggaggcuucgggucacuuggacuagacugcgaacccagaacaggccucgacuucucggaccuauacuaccuaacaaugaacaacaaacacuggcucgugcacaaagaaugguuccacgacauaccacuaccuuggcacgcaggagcagacacagguacaccacacuggaacaacaaggaagcacucguagaguucaaagacgcacaugccaaacgacagaccguagucguacucgggagccaagaaggggccguacacacggcccuggcaggagcacuagaagcagaaauggacggagccaagggccgacucagcagcggccaccucaagugcagauugaaaauggacaagcuacgacucaaaggcguaagcuacagucuaugcaccgccgcauucacauucacaaaaaucccagcagaaacgcuacacggcacagucaccgucgaaguucaguacgccggaacagacggaccaugcaaagugcucgcccagauggcagucgacaugcaaacgcuaacgcccguagguaggcucauaaccgcgaacccgguaaucacagaaagcacagaaaacagcaaaaugaugcucgagcucgacccacccuucggagacagcuacaucgucauaggggugggagaaaagaaaaucacacaccacuggcaccgcagcgguucaaccaucggcaaagccuucgaagcgaccguacgaggagcuaaaagaauggccguacucggagacacagccugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5203 - RNA, 1576 nt, Artificial Sequence
  KY014314.1 solE mRNA Design 1 opt
gggagaaagcuuaccaugagccagaaagucaucuaccuagucaugauccugcucauagcaccagcauacagcauaagauguaucggagucuccaacagagacuucgucgaaggaaugagcggaggaaccuggguagacguagucuuagaacacgguggcugcgucaccgugauggcacaagacaaaccgacaguagacauagaacucgucacaacaacaguaagcaacauggcagaaguacgaagcuacugcuacgaagcguccauaagcgacauggccagcgacagcagaugcccaacacaaggcgaagcauaccuagacaaacaauccgacacacaguacgucugcaaacgcacccuaguagacagaggguggggcaacggaugcggacuauucgggaaagggagccuagucacaugcgccaaauucgccugcucaaagaaaaugacaggaaaaagcauacaaccagaaaaccuagaauaccgaauaaugcuaagcguacacggaagccaacacagcggcaugaucguaaacgacaccggacacgaaacagacgaaaaccgagcaaaagucgaaauaacacccaacagcccccgagccgaggccacacuaggcgguuucggaagccucggacucgacugcgaaccacgcacagggcuagacuucuccgaccucuauuaccuaacaaugaacaacaaacacuggcucguccacaaagaaugguuccacgacauaccccuacccuggcacgcaggcgcggacacaggaaccccgcacuggaacaacaaagaagcccuagucgaguucaaagaagcccacgccaaacgacagacaguagucguccuaggaagccaagaaggagccguccacacagcccuagcaggagcacucgaagcagaaauggacggggccaaaggacgccuaagcuccggacaucuaaaaugccgccuaaaaauggacaaacucagacuaaaaggagucagcuacagccuaugcacagccgccuucaccuucaccaaaauaccggcagaaacacuccacggcacagucaccgucgaaguccaauacgcaggcaccgacggaccaugcaaaguacccgcacaaauggccguagacaugcaaacacuaaccccagugggacgacucauaacugccaacccagucaucaccgaaucaaccgaaaacagcaaaaugaugcuagagcucgacccaccauucggagacagcuacauagucaucggcgucggcgagaagaaaauuacgcaucacuggcacagaagcggcucgaccauaggcaaagccuucgaagcaacaguacgcggagcaaaacgaauggccguccucggagacacagccugggacuucggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5204 - RNA, 1576 nt, Artificial Sequence
  KX447517.1 solE mRNA Design 1 opt
gggagaaagcuuaccaugucgcaaaaagucaucuaccuaguaaugauccugcuaauagcaccagccuacaguaucagaugcauaggagucucgaacagggacuucguagagggaaugucagggggcacguggguagacgugguacuagaacacggcggaugcgugaccgugauggcgcaagacaaaccgaccguagacauagaacucgucacgacaacggucucaaacauggccgaggucaggagcuacugcuacgaagcgaguauaagcgacauggcaagcgacagcagaugcccgacacagggcgaggccuaccucgacaaacagagcgacacccaauacgugugcaaacgcacccuaguggaccgaggcuggggcaacggcuguggccuguucgggaaggggagccucgucacaugcgcaaaauucgccugcagcaagaaaaugacaggaaaaagcauccagcccgaaaaccuggaauacagaauaauguuaagcgugcacggaagccagcacucaggcaugaucguaaacgacacaggccacgagaccgacgaaaaccgcgcaaaaguggaaauaaccccgaacucgccgagggcagaagccgcccuagggggauucggcucgcuagggcuagacugcgagccaagaacaggccuggacuucagcgaccuauacuaccuaacgaugaacaacaaacacuggcuagugcacaaggagugguuccacgacauacccuugcccuggcacgcgggagccgacacaggaacgccucacuggaauaacaaggaagcccuagucgaguucaaagacgcacacgcaaaacgacagaccguaguagugcuagggagccaggaaggggcagugcacacggcucuggccggagcacuggaagcggaaauggacggggccaaaggcaggcucucauccgggcaccugaaaugccgccugaagauggacaaacuaagacucaaaggcgucagcuauagccuaugcacggccgcguucacguucacgaaaauaccagccgaaacgcuacacggaacggucacgguagaaguccaguacgcgggcacggacgggccaugcaaagugccggcgcaaauggccguagacaugcaaacgcucacgccagugggaaggcuaauaaccgcgaacccaguaauaacagaaagcacagaaaauagcaagaugaugcucgagcucgaucccccguucggggacucauacauagucauaggcgugggcgagaaaaagauaacgcaccacuggcacagaucgggaucgaccauaggcaaagccuuugaagcgaccguacgcggggcaaaacgcauggcaguacucggggacacggcaugggacuuugguucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5205 - RNA, 1576 nt, Artificial Sequence
  KU729217.2 solE mRNA Design 1 opt
gggagaaagcuuaccaugucccagaaagucauauaccucguaaugauccuacuaaucgcaccagcauacagcauaagaugcauaggcguuuccaaccgagacuucguagaaggcaugagcggcggcacauggguagacgucguccucgaacacggaggaugcguaaccgucauggcccaagacaaacccacagucgacaucgaacuggucucuacaacagucuccaacauggccgaaguccgaagcuacugcuacgaagcaaccauaucggacaucgcauccgacagccgcugcccgacacaaggcgaagccuaccucgacaagcaaagcgacacacaauacgucugcaaacgaacgcucgucgaccgaggcugggguaacggcugcggccucuucggcaaagggucccucguaacaugcgccaaauucgccugcucaaagaaaaugacaggcaaauccauccaaccagaaaaccucgaauacagaaucaugcuauccguacacggcagccaacacuccggcaugauuguaaacgacacaggccacgaaaccgacgaaaaccgagcaaaaguagaaaucaccccaaacagcccccgagcagaagccacccucggcggauucggaagccucggccucgacugcgaacccagaaccggacucgacuucagcgaccucuacuaccucaccaugaauaacaaacacuggcucguacacaaagaaugguuccacgacaucccccuacccuggcacgcaggcgccgacaccggaacaccccacuggaacaacaaagaagcacucgucgaguucaaagacgcccacgccaaacgccagaccgcagucguccucggaucacaggaaggcgccguccauacagcccuagccggcgcccuagaagcagaaauggacggcgcgaaaggccgccucagcagcggccaccuaaaaugccgccucaaaauggacaaacuacgccuuaaaggcgucagcuauagccucugcacagcugcauucaccuucacaaaaauccccgcagaaacccuacacggcacagucaccgucgaaguacaauacgccggcacagauggcccaugcaaagugcccgcccaaauggccguggacaugcaaacccucaccccagucggcagacucauaaccgccaacccaguaaucaccgaaucaaccgaaaacuccaaaaugaugcucgaacucgaucccccauuuggagacuccuacauagucaucggcguaggcgaaaagaaaaucacccaccacuggcaccgcagcggauccaccauaggcaaagccuucgaagccacaguccgaggagcaaaaagaauggccgugcucggagacacagcaugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5206 - RNA, 1576 nt, Artificial Sequence
  KY328290.1 solE mRNA Design 1 opt
gggagaaagcuuaccaugucacaaaaagucauauaccuagucaugauccuacuaauagcaccagcguauagcauacgcugcaucggaguaagcaacagggacuucgucgagggcaugagcggaggcacauggguggacgucguacuggaacacggaggaugcguaacagugauggcacaagacaaaccaaccguagacauagagcuaguaacaacaacagucucgaacauggccgaagucagaucauacugcuacgaagccagcauaagcgacauggcauccgacuccaggugcccaacccagggcgaagcauaccucgacaaacaaagcgacacacaguacguaugcaaaagaacccuaguggacagaggauggggcaacggaugcggacuauucggaaaagggagccucgucacaugcgcaaaauucgccugcagcaagaaaaugacagggaaaucaauacagccagaaaaccuagaauaccgaauaaugcucagcgugcacggaagccaacacucaggcaugaucguaaacgacaccgggcacgaaacagacgaaaaccgcgcaaaagucgaaauaacaccaaacucacccagagccgaggccacacuugggggauucggcagccucgguuuagacugcgaaccaaggaccgggcucgacuucucagaccuguacuaccucacaaugaauaacaaacacuggcucguacacaaagaaugguuccaugacaucccccuacccuggcacgccggcgcagacacaggcacgccacacuggaacaacaaagaagcgcucguggaguucaaagacgcccacgccaaacgccaaaccguaguggugcuagggagccaggaaggagcagugcacacagccuuagccggcgcccuggaagcagaaauggacggagcaaaaggccggcucagcagcggacaccucaaaugccgacugaaaauggacaaacuacgccuaaaaggagugagcuacagccucugcacagccgcguucacauucagcaagauacccgcggaaacacuacacggaacaguaacagaagaaguccaauacgcaggcaccgacggacccugcaaggugcccgcacaaauggccguagacaugcaaacacucacaccgguuggcagacucaucaccgcaaaccccgugauaaccgaaagcacagaaaacucaaaaaugaugcucgaacucgacccgccauucggagacucguacauaguaauaggaguaggcgaaaagaaaaucacgcaccacuggcaccgcagcggaucaacaaucggcaaagccuucgaagcgaccgucagaggagcaaaacgcauggcgguacugggagacacagcaugggacuucggaucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5207 - RNA, 1576 nt, Artificial Sequence
  KX087101.3 solE mRNA Design 1 opt
gggagaaagcuuaccaugucccaaaaaguaauauaccuaguaaugauccuccuaauagcacccgcauacagcauccgcugcauaggggucucgaacagggacuucguagaaggcaugagcggaggaacauggguagacguagucuuagaacacggcggcugcgucaccguaauggcccaagacaaaccaaccguagacauagaacuggucaccaccacgguaucgaacauggcagaaguccgaagcuacugcuacgaagccagcaucagcgacauggccucagacagccgaugccccacccaaggcgaagccuaccucgacaaacaaucagacacccaauacguaugcaaacgcacccuaguagaccgaggcuggggcaacggcugcggccuguucggaaaagggagccuggucacaugcgccaaauucgccugcuccaagaaaaugacaggaaaaucaauccaacccgaaaaccuagaauaucgcaucaugcuauccguacacggaucccaacacuccggaaugauaguaaacgacacaggacacgaaaccgacgaaaaccgcgccaaaguagaaauaaccccaaacucucccagagccgaagccacacucggaggauucggcucccuaggccuagacugcgaaccccggaccgggcucgacuucuccgaccucuacuaccucaccaugaacaacaaacacuggcucguccauaaagaaugguuucacgacauaccccucccauggcacgcaggcgcagacaccgguacaccacacuggaacaacaaggaagcgcuaguagaguucaaagacgcccacgccaaacgccaaaccguagucgugcuaggcagccaggaaggagccguacacacagcacuggccggagcucucgaagcagaaauggacggagccaaaggccggcuaucaagcggacaccuaaaaugccgccuaaaaauggacaagcuaagacucaaaggcgugagcuacagccuaugcacagccgcauucacguucaccaaaauaccugcagaaacccuacacggaacaguaacagucgaacuccaauacgcaggcacggacggacccugcaaagugcccgcccaaauggccguggacaugcaaacgcucacacccguaggaaggcucauuacagcaaacccagucaucaccgaaagcacagaaaacucaaaaaugaugcuagaacuugaucccccauucggagacucguacauagucaucggcguaggggagaaaaagaucacacaccacuggcaccgaucaggcucaacaaucggcaaggccuucgaagccaccguccgaggagcaaaacgaauggccguacuaggggacacagccugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5208 - RNA, 1576 nt, Artificial Sequence
  KY003156.1 solE mRNA Design 1 opt
gggagaaagcuuaccaugagccaaaaagucauauaccuggucaugauccuccuaauugcaccagccuacagcauacguugcaucggcaucuccaacagagacuuugucgaaggcaugagcggagggacguggguagacgugguacuagaacacggaggcuguguaaccguaauggcccaagacaaaccaaccgucgacaucgagcuagucacuacaacagucagcaacauggcagaaguccgaagcuacugcuacgaagccagcauaagcgauauggcgagcgacagcagaugcccaacccaaggugaagcauaccuagacaaacaaagcgacacccaguacgugugcaaacgcacacugguagaccggggcuggggcaacggcugcggccuguucggcaaaggaucccuagucacaugcgcaaaauucgccugcagcaagaaaaugaccggaaaaucuauccaaccagaaaaccuagaauaucgcauaaugcuaagcguacacggaagccagcacuccggaaugaucguaaacgacaccggacacgaaaccgacgaaaaccgagccaaaguagaaaucacccccaacucgcccagagcagaagcaacccuuggaggcuucggaauccuaggacucgacugcgaacccaggaccggacuagacuucagugaccuguacuaccuaacaaugaacaacaaacacuggcucguccacaaggaaugguuccacgacauaccccucccuuggcacgcaggcgcagacacaggaacgccacacuggaacaacaaggaagcacucgucgaguucaaagacgcccacgccaaacgucaaaccgucguaguccucggcucacaagaaggagccguacacacagcccuggcaggagcccucgaagcagaaauggacggagcaaaaggacgccuaagcagcgggcaccuaaaaugccgccuaaaaauggacaaacuccgacucaaaggcguaagcuacagccuaugcaccgccgcauucaccuucacaaaaauacccgcagaaacccuccacggcaccgucaccgucgaaguccaauacgcaggaaccgacggaccaugcaaaguccccgcacaaauggcaguagacaugcaaacccucacaccaguaggaagacucaucaccgcaaacccagucaucaccgagagcaccgagaacucaaaaaugaugcucgaacucgacccacccuucggcgacucuuauauagucaucgggguaggagaaaagaaaaucacacaccacuggcaccgaucgggcuccaccauaggaaaagccuucgaagcaaccguccgcggagccaaacgcauggcugugcucggagacacggcuugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5209 - RNA, 1576 nt, Artificial Sequence
  KU758876.1 solE mRNA Design 1 opt
gggagaaagcuuaccaugagccaaaaaguaauauaccucgucaugauacuacuaauagccccggcauacaguaucagaugcaucggggucagcaacagagacuucgucgaaggcaugaguggaggcacguggguagacguaguacuagaacacggaggaugcgucacagucauggcacaagacaaaccgaccguagacauagagcuaguaacaaccaccgucagcaacauggccgaagucagaagcuacugcuacgaagccaguauauccgacauggccagcgacucgaggugccccacccaaggcgaagccuaccuugacaaacaaagcgacacacaauacguaugcaaaagaacccuagucgaccgaggcuggggaaacggaugcggccucuucggaaagggaagccuagucacaugcgccaaauuugcaugcagcaagaaaaugacaggaaaaagcauacaacccgaaaaccuagaauaccgcaucaugcuaagcguccacggaagccagcauagcggcaugauaguaaacgacacagggcacgaaaccgacgaaaaccgagccaaaguagaaaucacaccaaacagccccagagccgaagccacgcucggaggcuucggaagccuaggacucgacugcgaacccagaaccggacucgacuucagugaccucuacuaccuaacaaugaauaacaaacacuggcugguccacaaagaaugguuccacgacaucccacuacccuggcacgcaggagcggacacgggcacaccacacuggaacaacaaagaagcucucguagaauuuaaagacgcccacgcaaaacgccagaccguagucguccuaggaagccaagaaggagccguacacaccgcccuggcaggagcgcuggaagcggaaauggacggaguaaaaggaaggcuaagcagcggccaccucaaaugccgccuaaaaauggacaaacuacgccuaaagggcguaagcuacagccuaugcacagccgcguucacauucacaaagauaccagccgaaacgcuccacgggacagucacaguagaaguccaauacgcaggaacagacggaccaugcaaagugccagcacaaauggccgucgacaugcaaacccuaacccccguaggccggcuaauaacagcaaacccugucauaaccgaaucgacagaaaacuccaagaugaugcuagaacucgaucccccauucggcgacaguuacauugucauaggagugggcgaaaagaaaauaacacaccacuggcaucgaagcggaucaaccaucggcaaagccuucgaagccaccguacgaggagccaaacgcauggcagugcuaggcgacacagcaugggacuucggcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5210 - RNA, 1576 nt, Artificial Sequence
  KU926310.1 solE mRNA Design 1 opt
gggagaaagcuuaccaugagccaaaaaguaauauaccuagucaugauccuacucauagccccagcauacagcauacgcugcauaggaguguccaaccgagacuucgucgaaggcaugucaggcggcacguggguagacguaguacuagaacacggcgggugcguaacagugauggcccaagacaaacccacagucgacaucgagcucgucacaaccacagucuccaacauggccgaagucagaucauauugcuacgaagcaagcaucuccgacauggcaagcgacagcagaugcccaacccaaggagaagccuaccuugacaaacaaucagacacccaauacgucugcaaacgcacccuagucgaccggggauggggcaacggaugcgggcuauucggaaaaggaucccuaguuacaugugccaaauucgcaugcucaaagaaaaugaccgggaaaucaauacaacccgaaaaccuagaauaccgcaucaugcugagcguacacggcagccaacauucaggcaugaucguaaacgacaccggacacgaaacagaugaaaaccgcgccaaaguggaaauaacuccaaacucccccagagccgaagccacacucggaggcuucggcucgcucggacucgacugcgaacccagaacaggccuugacuucucagaccuauauuaccuuacaaugaacaacaaacacuggcucguacacaaagaaugguuccacgauauaccccuacccuggcacgcaggcgcagacaccggcacaccccacuggaacaacaaagaagcccuaguagaguucaaagacgcacacgcaaaacgccaaaccgucguaguccucggaucacaagaaggcgccguacacacggcccuugccggcgcacuagaagcagagauggacggcgccaaaggccgacuaucaagcgggcaccugaaaugcagacucaaaauggacaaacuccgacuaaagggcguguccuacucacuaugcacagcagcauucacauucacaaagauacccgcagaaacccuacacggaacgguaacagucgaaguacaauacgccggcgcagauggaccaugcaaaguacccgcgcaaauggccguagacaugcaaacacucacgcccgucggacgacucauaacugcgaaccccgucauaacagaaagcacagaaaacuccaaaaugaugcuagaacucgaucccccauucggcgacuccuauauagucaucggcgucggagagaagaaaauaacacaccacuggcaccgcuccggcuccacuaucggcaaagccuucgaagccaccguacgaggagccaaacgaauggccguccucggagacaccgcaugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5211 - RNA, 1576 nt, Artificial Sequence
  KU681081.3 solE mRNA Design 1 opt
gggagaaagcuuaccaugucccagaaagucaucuaccugguaaugauccuacuaauagcccccgcauacagcauaagaugcaucggaguauccaacagagacuucgucgaaggaauguccggcggcacauggguagacguagucuuggaacacggaggcugcguaaccgucauggcacaagacaaacccaccgucgacaucgaacucgucacgaccacagucucgaauauggccgaagucagaagcuacugcuacgaagcaagcauaagcgacauggccagcgacagcagaugcccaacccaaggcgaagccuacuuagacaaacaguccgacacccaauacguaugcaaacgcacccucguagaccgaggcuggggaaacggcugcggccuguucggaaaaggaagccucguaaccugcgcgaaauucgccugcuccaagaaaaugaccggaaaaucaauccagccugaaaaccucgaauaccgcauaaugcucagcguccacggaagccagcauagcggcaugaucguaaaugacacaggacacgaaaccgacgaaaaccgcgcaaaaguagaaauaacaccgaacucccccagggccgaggccacacucggcggcuucggcucgcucggccucgacugcgaaccaaggaccggacuagacuucagcgaccuauacuaccucacaaugaacaacaaacacuggcuaguacacaaagaaugguuccacgacauaccccucccauggcacacaggcgccgacaccggcacaccccacuggaacaacaaagaagcccuaguagaguucaaagacgcccaugccaaacgccaaaccguggucguccucggaucacaggaaggcgccguucacaccgcucuagcaggagcccuagaagccgaaauggacggagccaagggacgacucucaagcggacaccucaaaugcagacucaaaauggacaagcuacgacuaaaaggaguaagcuauagccugugcaccgcagcauucaccuucaccaaaauacccgcagaaacacuccacggcacgguaaccgucgaaguacaauacgcaggcaccgacggcccaugcaaaguacccgcccaaauggccgucgacaugcaaacacuaacccccguaggccgacucauaacagcaaacccagucauaaccgaaggcaccgaaaauagcaagaugaugcucgaacuggacccgcccuucggcgacucguacauagucauaggagugggcgagaaaaagaucacacaccacuggcaccgcuccggcucaaccauaggcaaagccuucgaagccaccguccgaggggccaaacgcauggccgugcucggagacacagccugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5212 - RNA, 1576 nt, Artificial Sequence
  KU744693.1 solE mRNA Design 1 opt
gggagaaagcuuaccaugucgcaaaaaguaauauaccucgucaugauccuccucauagcccccgccuacuccauacgcugcauaggcgucuccaaccgggacuucgucgaaggaaugagugggggcaccugggucgacguaguccuagaacacggcggaugcguaaccgcaauggcccaggacaagcccaccgucgacauagaacucguaacgacaacagucuccaacauggccgaagucagauccuacugcuacgaagcaagcaucucagacauggcaagcgacagccgaugcccaacccaaggcgaagccuaccuagacaaacaaagcgacacccaauacguaugcaaacgaacccuagucgaccgcggcuggggcaacgggugcggccuauuugggaagggaagccucgucacaugcgcaaaauuugcaugcagcaaaaagaugaccgggaaaagcauccaaccagaaaaucucgaauaccgcauaaugcuauccguccacggcagccaacacagcggcaugcuaguaaacgacaccggacacgaaaccgacgaaaaccgcgcaaaaguagaaauaacaccaaacuccccacgagcagaagcaacacucggcggcuucggaagccuaggccuagacugcgaacccagaaccggacucgacuucagcgaccucuacuaccucacaaugaacaacaaacacuggcuagcccacaaggaaugguuccacgacaucccacuacccuggcacgcaggcgcagcaacgggaacaccacacuggaacaacaaagaagcccuaguagaguucaaagacgcacaugcuaaacgacaaaccgucguaguacuaggaagccaagaaggcgcaguccacaccgcccucgccggagcacuagaagccgaaauggacggagccaaggggagacuuucaagcggccaccuaaaaugucgccuaaaaauggacaaacuacgccucaaaggcgucagcuacagccucugcacagccgcauucacauucaccaaaauaccugcugaaacagucgacggaacaguaacagucgaaggacaauacggaggaacugacggccccugcaagguaccagcacaaauggccgucgacaugcagacgcuaacgccaguaggacgacucauaaccgccaacccagucauaaccgaauccacagaaaacagcaaaaugaugcucgaacuagacccacccuucggggacuccuacauagucauaggagucggcgaaaagaaaaucacccaccacuggcaccgcagcggcucaaccauaggcaaagcauucgaagcgacaguacgcggagcaaaacgcauggccguacuaggagacacagccugggacuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5213 - RNA, 1576 nt, Artificial Sequence
  EU545988.1 solE mRNA Design 1 opt
gggagaaagcuuaccaugucccaaaaggugauauaccuagucaugauccuccuaauagccccagccuacagcauacggugcaucggagucuccaacagagacuucgucgaaggcaugagcggaggaacauggguagacguaguccuagaacacggcggaugcguaacagugauggcgcaagacaaaccagccguagacauagaacuggucacaacaacggucagcaacauggcagaagucagaagcuacugcuacgaagcaagcauaagcgacauggcgagcgacagcagaugcccaacccagggcgaagcauaucucgacaaacaaucagacacacaguacguaugcaagagaacgcucguagaccgaggcuggggcaacggaugcggccuguucggaaaggggagccucgucacgugcgcgaaauucgcgugcagcaagaaaaugaccgggaaaucaauacagccagagaaccuggaauaccgaauaaugcucagcguccacggcagccaacacagcggcaugaucgucaacgacacaggacaugaaaccgacgaaaaucgcgcaaaagucgaaaucacaccgaacucgcccagagccgaagccacacucgggggauucgguagccuaggacucgacugcgagcccaggacaggacucgacuucucggaccuguacuaccuaacaaugaacaacaaacacuggcucgugcacaaagaaugguuccacgacauaccccuacccuggcacgcaggcgcagacacaggcacaccccacuggaacaacaaagaagcccuaguggaguucaaagacgcacaugcaaaacgacaaaccguaguagugcuaggaagccaggaaggagccguacacacagcccuggccggagcauuggaagccgaaauggacggagcaaaaggcaggcucuccagcgggcaccugaaaugccgccugaaaauggacaaacuacgacucaaaggcguguccuacagucucugcaccgcagcguucacauucacaaaaauacccgcagaaacgcuccacggcacggucacggucgaaguccaauacgcuggaaccgacggacccugcaaaguaccagcgcaaauggccguggacaugcagacgcucacaccagugggacggcucauaacagcgaacccagucauaacagaaagcacagaaaacaguaaaaugaugcucgaacuagacccgcccuucggggacuccuacauaguaaucggcguaggcgaaaagaaaauaacgcaccacuggcaccgcuccggcaguaccauaggaaaagcauucgaagcgacaguacgaggagccaagcgcauggcgguacugggagacacagccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5214 - RNA, 1576 nt, Artificial Sequence
  KY007221.1 solE mRNA Design 1 opt
gggagaaagcuuaccaugagccaaaaagucaucuaccuuguaaugauccuccuaauagccccagcguacagcauccgcugcaucggcguaaacaacagggacuucguagaaggcauguccggaggcaccuggguagacgucguacucgaacacgguggaugcguaaccguaauggcccaagacaaaccaaccguagacaucgagcuagucacgaccacaguaagcaacauggcagaagucaggagcuacugcuacgaagcaagcaucagcgacauggcaagcgacagccgcugcccaacccaaggagaagcguaccucgacaaacaaagcgacacacaauacgucugcaaaagaacccucguggaccgaggcuggggcaacggcuguggccuauucggcaaagggagccuagucacaugcgccaaauucgcaugcagcaagaaaaugaccggaaaaagcauccaacccgaaaaccuagaauaccgaauaaugcugagcguccacggaagccaacacucaggcaugaucgucaacgacaccggccacgaaacagacgaaaacagagcaaaaguagaaaucaccccaaacagccccagagccgaagcaacacuaggcggcuucggaagccugggacuggacugcgagccccgaaccggacuagacuucucagaccuauacuaccucacaaugaauaacaaacacuggcuaguacacaaagaaugguuccacgacauaccacugccauggcacgccggcgcggacaccggaacaccccacuggaacaacaaagaagcacucguagaguucaaagacgcccacgccaaacgccaaaccgucguaguacuaggcagccaagaaggagccguacacacagcccuggccggagcacucgaagccgaaauggacggggccaaaggccgacucuccagcgggcaccucaaaugccgccucaaaauggacaaacuacgacucaaaggcguaagcuacagccucugcacagccgcauucacauucaccaaaauacccgccgaaacccuacacgguacagugacagucgaaguacaauacgcaggcacggacgggcccugcaaaguacccgcacagauggccguagacaugcaaacacuaacaccagucggcagacucaucacagccaaccccguuaucaccgaaagcacagaaaacagcaaaaugaugcucgaacuagacccaccauuuggcgacagcuacauagucauuggagucggagaaaagaaaaucacacaccacuggcacagauccggcagcacaaucggaaaagccuucgaagcaaccguccgaggcgcgaaacgaauggcaguacuaggagacacagcaugggacuucgguagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5215 - RNA, 1576 nt, Artificial Sequence
  KY003152.1 solE mRNA Design 1 opt
gggagaaagcuuaccaugucccaaaaaguaauauaccuaguaaugauauuacucauagcaccggccuacagcauccgcuguauagggguauccaacagagacuucgucgagggcaugagcggcggcacaugggucgacgucguacuagagcacggcggcugcguaacagucauggcacaagacaaaccaaccguggacaucgagcuagucaccaccacagucucaaacauggccgaagucagaagcuacugcuacgaagcgagcaucagcgacauggcaagcgacagcagaugcccaacccaaggcgaggcuuaccucgacaagcagagcgacacccaauacgugugcaaacgcacgcuaguagacagaggcuggggaaauggaugcggacuuuucggaaaaggaagccuaguuacgugcgcaaaauucgccugcagcaagaaaaugaccgggaaaucaauccaacccgaaaaccuagaauaccgaauaaugcuaagcguacacggcagccaacacucgggaaugauaguaaacgacacaggacacgagacagacgaaaacagagccaaaguagaaauaacaccgaacucacccagggccgaggcaacacucggaggcuucggcucgcuagggcucgacugcgagcccagaaccggccuagacuucuccgaccuauacuaccucacaaugaauaacaaacacuggcuaguacacaaggaaugguuccacgacauaccacugcccuggcacgcaggcgcagacacaggaacaccccacuggaacaacaaggaagcccuagucgaguucaaagacgcacacgcaaagcgacaaaccguagucguccuuggaagccaagaaggagccguacacacagcccucgcaggggcccuggaagcagaaauggacggagccaaaggcagacuauccagcggacaccugaagugccgacucaaaauggacaagcucaggcucaagggagucuccuacagccuaugcgcagccgccuucacauucacaaaaauacccgcggaaacgcuccacggcacaguaacggucgaaguccaguacgcaggcacagacggacccuguaaaguacccgcgcaaauggcagucgacaugcaaacacuaacaccagucggcaggcucauaaccgccaacccggucauaaccgagaguacagaaaacagcaaaaugaugcucgaacucgaucccccauucggagacagcuacauaguaauaggaguaggcgaaaagaaaaucacccaccacuggcacagaucaggcucaacaauaggcaaagcauucgaagcaaccguacgcggagcaaaacgaauggccguccuaggggacaccgccugggacuuugguucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5216 - RNA, 1576 nt, Artificial Sequence
  KX694533.2 solE mRNA Design 1 opt
gggagaaagcuuaccaugucacaaaaaguaaucuaccucguaaugauccuacuaaucgcacccgccuacagcauacgaugcaucggaguaucaaaccgcgacuucgucgaagguauguccggcggaacauggguagacgucgucuuagaacacggagggugcguaacagucauggcccaagacaaaccaacaguagacauagagcucguaacaaccaccguaagcaacauggcagaaguccgcagcuacugcuacgaggccagcauaucagacauggccuccgacucacgaugcccaacacaaggagaagcauaccuagacaaacaaagcgacacccaauacgucugcaaaagaacacuggucgacagaggauggggcaacggaugcggccuauucggaaaaggcagccuaguaaccugcgcaaaauucgccugcagcaagaaaaugaccggcaaauccauacaaccagaaaaucuagaauaccgaauaaugcuauccguccacggaagccaacacuccggcaugaucgucaacgacaucggccacgaaaccgacgaaaaccgagccaaagucgaaaucacccccaacucaccccgagcagaagccacacucggcggcuucggaucccucggacuagacugcgaacccagaacaggccucgacuucagcgaccucuacuaccuaacaaugaacaacaaacacuggcucguccacaaagaaugguuccacgacauaccacugcccuggcacgcaggcgccgacacaggcacgccccacuggaacaacaaagaggcacucguggaguucaaagacgcccacgccaaaagacaaacaguaguaguacucggcagccaagaaggagccguccacacagcccucgcaggagcccucgaagccgaaauggacggagccaaaggcagacucuccagcgggcaccugaaaugccgccucaaaauggacaaacuacgccucaaaggcgucagcuacagccucugcacagcagccuucaccuucaccaaaauccccgccgaaacacuccacggaaccguaacaguagaaguccaauacgccggcacagacggacccugcaaaguacccgcacaaauggccgucgacaugcagacccucacgcccguaggaagacucaucaccgcaaaccccgucauaaccgaaagcacagaaaacagcaagaugaugcuagaacucgacccacccuucggagacagcuacaucguaauaggagugggagacaagaaaaucacacaucacuggcaccgcagcggcucaacaauaggcaaagcauuugaagccacaguacgcggggccaaaagaauggccguccuaggggacaccgccugggacuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5217 - RNA, 1576 nt, Artificial Sequence
  KX601167.1 solE mRNA Design 1 opt
gggagaaagcuuaccaugagucaaaaagucauauaccucgucaugauccugcuaaucgcccccgccuacagcauacgcuguaucggagugagcaacagggacuucguagaaggaaugaguggaggcaccugggucgacguaguacuagaacacggaggaugcguaaccguaauggcacaagacaaaccaaccguagacaucgagcuagucacaaccacagucucaaacauggccgaagucagaagcuacugcuacgaagcaagcaucagcgacauggcaagcgacagccgaugcccaacacaaggagaagcauaccuagacaaacaaagcgacacccaauacgugugcaaacgcacccuagucgaccgaggauggggcaauggaugcggccucuucggaaaaggaucccuagucacaugcgcgaaauucgcaugcagcaagaaaaugacuggaaaaucaauccagccagaaaaccuagaauaccgaaucaugcucucgguacacggcagucaacacagcgguaugauagugaacgacaccggacacgaaaccgaugaaaacagagccaaagucgaaauaaccccaaacucccccagagccgaagccacacuaggaggcuucggaucgcuaggacuugacugcgaaccaagaaccggacuagacuucuccgaccuauacuaucuaacaaugaacaacaaacacuggcucgugcacaaagaaugguuccacgauauaccacugccauggcacgcaggagcggacacaggaacaccccacuggaacaacaaagaagcccuaguagaguucaaagacgcccacgccaaacgacaaaccgucgucguacuaggcagccaggaaggagccguacacacagcccucgcgggcgcccuagaagccgaaauggacggagcaaaaggcagacuaucgucaggccaccucaaaugccgccugaaaauggacaaacuaaggcucaaaggagugucauacagccucugcacagccgcguucacauucacaaaaauaccagcagaaacacuccacggaacaguaacaguagaaguccaauacgcaggaacagacggacccugcaaaguccccgcccaaauggccguagacaugcaaacccucacgccagucggcagacugauaaccgcaaacccaguaaucacagaaagcacagaaaacucaaaaaugaugcucgaacuagacccaccauucggcgacagcuauauaguaauaggcgucggagacaagaaaaucacacaccacugguaccgcucaggcuccaccaucggaaaagccuucgaagccaccguacgaggagcaaaacgcauggcagugcuaggggacacggccugggacuucggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5218 - RNA, 1576 nt, Artificial Sequence
  KY288905.1 solE mRNA Design 1 opt
gggagaaagcuuaccaugagccaaaaaguaauauaccuaguaaugauccuacuaauagcccccgcauacagcauccgcugcauagggguauccaacagggacuucgucgaaggcaugagcggaggcacaugggucgacgugguccuagagcacggaggcugcguaaccguaauggcacaagacaaaccaaccgucgacaucgaacuggucaccaccacaguuagcaacauggccgaagucagaagcuacugcuacgaagcaagcaucucagacauggcaagcgacucccggugccccacacaaggagaagcauaccuagacaaacagagcgacacccaauacguaugcaaacgcacacucgucgaccgaggcuggggcaacggcugcggacuauucggaaaaggaagccucgucacaugcgcaaaauucacaugcagcaaaaaaaugacaggaaagagcauccaaccagaaaaccuagaauaccgcauaaugcuaagcguacacgguagccaacacucaggcaugauagucaacgacaccggccacgaaaccgacgaaaaccgagccaaaguagaggucacccccaacagcccacgagccgaagcaacccuaggcggcuucggcagcuuaggccucgacugcgaaccccgcaccgggcuagacuucagcgaccuauacuaccuaaccaugaacaacaaacacuggcucgugcacaaagaaugguuccacgacauacccuuaccauggcacgccggcgcggacacaggcacaccccacuggaacaacaaagaagcccucgucgaauucaaagacgcucacgccaaacgccaaacaguaguaguacuaggcagccaggaaggcgcgguacacaccgcccuagccggagcccuagaagccgaaauggacggggccaaaggccgacucuucagcggacaccugaaaugccggcugaaaauggacaaacucagacuaaaaggcgucagcuacagccuaugcacagcagccuucacauuuacaaaaguacccgcagaaacacuccacggcaccgucacagucgaaguacaauacgcaggcacagacggcccaugcaaaguaccagcacaaauggccguagacaugcaaacacucacaccagugggcagacucaucaccgccaacccaguaauaaccgaaagcaccgaaaacuccaaaaugaugcuagaacucgacccaccauucggcgacuccuacauaguaauaggcgucggcgacaaaaaaaucacacaccacuggcaucgaagcggcuccacaaucggcaaagcauucgaagcaaccguaagaggagccaaacgaauggcuguacucggcgacaccgcaugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5219 - RNA, 1576 nt, Artificial Sequence
  KF268950.1 solE mRNA Design 1 opt
gggagaaagcuuaccaugucgcaaaaagucaucuaccuaguaaugauccuccucauagccccagcuuacagcaucagauguaucggaguauccaacagagacuucgucgaaggcaugagcgggggcacaugggucgacguaguccuagagcacggcgggugugucacuguaauggcgcaagacaaaccaacaguagacauagagcuaguaacaaccaccgucucaaacauggccgaaguccgaagcuacugcuaugaagccagcauaagcgacauggcaagcgacagcagaugcccgacacaaggcgaagccuaccuagacaaacaaagcgacacccaauacguaugcaaacgcacccuaguagaccggggauggggaaacggcugcggccuauucgggaaaggaagccuaguaacaugcgccaaauucacaugcagcaagaaaaugaccgggaaaucaauccaacccgaaaaccuagaauaccgcauaaugcugagcgugcacggaagccaacacucaggcaugauaguaaacgacaucggccacgaaacagacgaaaaccgagcgaaaguagaagugacaccgaacucacccagggcagaagccacgcucggaggcuucgguucguuaggacuagacugcgagcccagaacaggacucgacuuuucggaccuguacuaccuaaccaugaacaacaaacacuggcugguacacaaagaaugguuccacgacauaccccugccauggcacgcaggagcagacacuggcacaccccacuggaacaacaaagaagcacucguggaguucaaagacgcccacgccaaacgacaaaccgucgucgugcucggaagucaagaaggagcagugcacaccgcccucgccggagcacuagaagcggaaauggacggggccaaaggccgccucuucagcggacaccucaaaugcaggcugaaaauggacaaacuaagacucaagggaguaagcuacagccucugcaccgcugcauucaccuucacgaaaguacccgcggaaacgcuacacggaacaguuacggucgaaguccaguacgcaggcacggacgggcccugcaaagugcccgcacagauggccguugacaugcaaacacucaccccagucggcagacucauaacugcaaacccggucaucaccgaaaguacggaaaacagcaagaugaugcuagagcuagaucccccauucggggacuccuacauagucaucggcgugggcgacaagaaaaucacgcaccacuggcaccgaucgggcucgaccaucggcaaagccuuugaagcaaccgugcgaggagccaaacgcauggccguccucggcgacacagccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5220 - RNA, 1576 nt, Artificial Sequence
  KF383116.1 solE mRNA Design 1 opt
gggagaaagcuuaccaugucccaaaaaguaauauaccucgucaugauacuccucauagcccccgcauacagcauacgcugcaucggggucuccaacagagacuucgucgaaggaaugagcggaggcacauggguggacguaguccuggaacacggaggaugcguaaccguaauggcccaagacaaaccaaccgucgacauagagcuaguuacaaccaccgucuccaacauggccgaaguccgcuccuacugcuacgaagccagcauaagcgacauggccagcgacagcagaugcccgacccaaggcgaagccuaccuagacaaacaaagugacacccaauacgucugcaaacgaacacucguagaucgcggcuggggcaacggcugcggucuguucggaaaaggaagccuaguaaccugcgccaaauucacaugcagcaagaaaaugaccggaaaaucaauccagcccgaaaaccucgaauaccgcauaaugcuauccguacacgguagccaacacuccggcaugaucgucaacgacaucggacacgagacagacgaaaaccgcgccaaaguagaaguaaccccaaacucccccagggccgaagcaacacucggaggcuucggaucccuaggacuagacugcgaacccagaaccggccucgauuucagcgaccuauacuaccucacgaugaacaacaaacacuggcucguacacaaagaaugguuccacgacauaccccuacccuggcacgccggcgcagacaccggcacaccccacuggaacaacaaagaagcacucguagaguucaaagacgcacacgcaaaacgccaaaccguaguaguccuaggcagccaagaaggcgccguacacaccgcccuggccggagcgcuagaagcagaaauggacggagccaaaggcagacuauucagcggccaccuaaaaugccgacuaaaaauggacaaacucagacucaaaggaguaagcuacagccuaugcaccgccguaugcaccgccgccaaaguccccgcagaaacacuacacggcacagucacaguagaaguccaauacgcaggcacggacggccccugcaaagugccagcccaaauggccguagacaugcaaacucugacaccagucggcagacucauaaccgccaacccaguaauaacagaaagcacggaaaacucaaaaaugaugcuugaacucgacccgcccuucggagacucauacauagucauaggaguaggcgacaagaaaaucacacaccacuggcaccggagcggcuccacuauaggcaaagcauucgaagcaaccguaagaggagccaaacgaauggccguacuaggggacacagcaugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5221 - RNA, 1558 nt, Artificial Sequence
  KU963574.2 solE mRNA Design 1 opt
gggagaaagcuuaccaugucgcaaaaagucauauaccuggucaugauccugcuuaucgcacccgcuuacuccauccgcugcaucggagucucgaacagggacuucgucgaaggcaugagcggaggcacauggguagacguaguccuagaacacggcggcugcgugaccgucauggcacaagacaaaccgacaguagacauagaacucgucacaaccacagucucgaacauggcagaaguuagaaguuacugcuacgaagccagcauaagcgacauggcaagcgacagcagaugcccaacccaaggggaagcauaccuggacaaacaaagcgacacccaauacgucugcaaacgcacgcuaguagacaggggauggggcaacggaugcggacuguucgggaaaggaagccuagucacaugcgcgaaguucacaugcagcaagaaaaugacaggaaaauccauacaacccgaaaaccuagaauaccgaauaaugcugagcgugcacggaagccaacacagcggcaugauaguaaacgacgaaaaccgcgcgaaaguagaaguaaccccaaacagcccaagggccgaggcaacgcuaggaggauucggaagccuagggcucgacugcgagcccagaaccggacucgacuucucggaccuauacuaccuaacgaugaacaacaaacacuggcuaguacacaaagaaugguuccacgacauaccgcuccccuggcacucgggagcagacaccgaaacgccacacuggaacaacaaagaagcgcuaguagaguucaaagacgcccacgccaagcgacagacaguagucguacucgggagccaggaaggagccguacacacagcccucgccggagcccucgaagcagagauggacggagccaaaggccgacuaucguccggccaccuaaaaugccgccugaaaauggacaaacucaggcuaaaaggcgugagcuacagccugugcaccgccgcauucacauucacaaaagugcccgcagaaacacuccauggaacagucacagucgaaguccaauacgcaggaagggacgggcccugcaaaguacccgcgcagauggcaguagacaugcaaacgcuaacccccgucggcagacucauaacagcgaacccggucauaaccgaaagcacagaaaacagcaaaaugaugcuagaauuagaucccccauucggggacucauacaucgucauaggcguaggcgacaagaaaauaacacaccacuggcacagaucaggcuccauaauaggcaaagccuucgaagcaacagugcgaggagccaaacgcauggcaguacuaggagacaccgccugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5222 - RNA, 1576 nt, Artificial Sequence
  KF383118.1 solE mRNA Design 1 opt
gggagaaagcuuaccaugucacaaaagguaauauaccuagucaugaucguacucauagucccggcauacagcauaagcuguaucggaguaucaaaccgagaccugguagagggcaugagcgggggcacauggguggacgugguacuggaacauggcggaugcguaaccgaaauggcgcaagacaaaccgaccguggacauagagcuaguaacaaugaccgucucgaacauggcagaagucagaagcuacugcuacgaagcaagccugagcgacauggcaagcgcaaguaggugcccgacccaaggagaaccaucacuagacaaacaaagcgacacccagagcguaugcaagagaacgcuaggggacagaggcuggggaaacggcugcggaaucuucggaaaaggaucccuagucacgugcuccaaauuuacaugcugcaagaaaaugccagggaaaagcauccagccagagaaccucgaauauagaauaaugcuacccgugcacggcagccagcacucaggaaugaucgugaacgacaucggacacgagaccgacgaaaaccgcgcaaaaguggaaguaaccccaaacucacccagagcagaagccacgcucggaggauucggaagccucgggcucgacugcgaaccccgaaccgggcucgacuucucagacuuauacuaccuaacaaugaacaacaagcacuggcucguacacaaagagugguuccacgacauaccccugccauggcacgcgggagcagacacaggcacgccgcauuggaacaacaaggaggcacucguagaguucaaagacgcgcacgcaaagcgacaaacagucguagugcucggaagccaagaaggggccguccacacagccuuagccggggcccucgaagcagaaauggacggggcaaagggccggcucuuuagcggccaccuaaaaugccgccuaaaaauggacaagcuaagacuaaagggcguaagcuacagccugugcacagccgcauucacauucacaaaaguacccgcagaaacgcuccacggcacagucacagucgagguccagagcgcgggaacggacggacccugcaaaguaccagcgcaaauggccguagacaugcaaacacucacccccgugggaaggcuaauaacagcaaacccgguaauaaccgaaagcacagaaaacagcaagaugaugcucgaguuagacccaccauucggggacucauacauaguuauaggcguaggcgacaagaaaaucacgcaccauuggcacagauccggaaguaccaucggcaaagccuucgaagcaaccgugcgcggggccaagagaauggcagugcucggagauaccgcaugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5223 - RNA, 1576 nt, Artificial Sequence
  KX520666.1 solE mRNA Design 1 opt
gggagaaagcuuaccaugcgacaaaaagucauuuaccuaguaaugauacuccuaauagccccagccuacagcauuagaugcaucgggguaucaaacagggacuucguagaaggaaugagcggcggaaccuggguagacgucguccucgaacacggcggcugcguaaccguaauggcacaagacaaaccgaccguagacauagaacucgucaccaccacagucucaaacauggcagaaguccggagcuacugcuacgaggcuucuauaagcgacauggcaagcgacagcagaugcccaacccaaggcgaagcauaccuagacaaacaaagcgacacccaguacguaugcaaaagaacccucguagaccgaggauggggcaacggcugcggccuguucggaaaaggaagccugguaacaugcgcaaaauuugccugcagcaaaaagaugacagggaaauccauccaacccgaaaaccuagaauacagaauaaugcucagcguacauggaagccaacauagcggcaugaucgucaacgacacaggacacgagacagacgaaaaccgcgcaaaaguagaaaucaccccaaacucacccagggccgaggcaacacucggcggauucggcagccucggccucgacugcgaacccagaaccggccucgacuucucagaccuguacuaucuaaccaugaacaacaaacacuggcucguccacaaagaaugguuccacgacaucccacugcccuggcacgccggcgccgacacaggaacaccacacuggaacaacaaagaagcccuagucgaguucaaagacgcacacgcaaaacgacaaacagucgucguccucggcagccaagaaggagcaguccacacggcccuggcaggagcccucgaagcagaaauggacggagccaaaggcaggcucucaucaggacaccuaaaaugccgccuuaaaauggacaaacuccgacugaaaggaguauccuacagccucugcacagccgcauucaccuucacaaaaauaccagcggaaacacugcacggcacagucaccgucgaaguccaguacgcaggcaccgacggccccugcaaaguaccagcacaaauggcgguggacaugcaaacccuaaccccaguaggccgacuaauaaccgcgaacccagucauaaccgagagcaccgaaaacaguaaaaugaugcucgagcucgacccaccauucggagacagcuacauaguaauaggcgucggugaaaagaaaaucacacaccacuggcaccgcucgggcucaaccaucggcaaagccuucgaagcaacuguacgcggagccaaacgcauggcaguacuaggagacacagcaugggacuucggcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5224 - RNA, 1576 nt, Artificial Sequence
  KF383120.1 solE mRNA Design 1 opt
gggagaaagcuuaccaugagccaaagagucaucuaccugguaaugauccuacuaauagccccagccuacagcauccgaugcaucggggucucgaacagagacuucgucgaaggcaugagcggaggcacauggguagacguagugcuggaacacggcggaugcguaaccguaauggcacaagacaaaccaaccguagacauagagcuagucacaacaacagucucaaacauggccgaagucaggaguuacugcuacgaagcaagcauaagcgacauggccagcgacagccgaugcccaacccaaggcgaagcauaccuagacaaacaaagcgacacccaauacgugugcaaacgcacgcuagucgacagaggauggggcaacgggugcggccucuucgggaaaggaagccuagucacgugcgcaaaauucacaugcagcaagaagaugaccggaaaaucaauccaacccgaaaaccuagaauaccgcauaaugcugagcguccacggaagccaacacucaggcaugaucgucaacgacaucggacacgagaccgacgaaaaccgagcgaaaguggaaguaaccccaaacucaccaagggccgaggccacccucggaggcuucggaucgcucgggcuagacugcgaacccagaaccggacucgacuucucagaccucuacuaccucacgaugaacaacaaacauuggcucgugcacaaagaaugguuccacgauaucccacugcccuggcacgcaggcgcggacacaggaacaccccacuggaacaauaaggaagcacuuguagaguucaaagacgcccacgccaaacgccagaccguagucguacuaggaagccaagaaggagccgugcacaccgcccuggcaggagcacuggaagcagaaauggacggagccaaaggccgacucuucagcggacacuugaaaugccgcauaaaaauggacaaacucaggcucaaaggcgugagcuacagccuaugcacugccgcauucacauucuccaagguaccagcagaaacacuccacggcaccgucacgguagaaguccaauacgcaggccgagacgggccaugcaaagugcccgcacaaauggccguagacaugcaaacgcucacacccguaggcaggcucauaacagcgaacccaaucauaacagaaaguacagaaaacagcagaaugaugcuagaacucgacccaccguucggggacuccuacauagucaucggcgugggcgacaagaaaauaacacaccacuggcauagaucgggcucaaccauaggcaaagccuucgaagcgacagugcgaggagcaaaaagaauggccguacuaggagacacagcaugggauuucggcucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5225 - RNA, 2524 nt, Artificial Sequence; identical to SEQ ID NO: 290
  R4797 ZIKV (strain ZikaSPH2015) Polyprotein(93-804) mRNA Design 2 wild type

SEQ ID NO: 5226 - RNA, 2524 nt, Artificial Sequence; identical to SEQ ID NO: 294
  ZIKV (isolate Z1106033) Polyprotein(93-804) mRNA Design 2 wild type

SEQ ID NO: 5227 - RNA, 2512 nt, Artificial Sequence; identical to SEQ ID NO: 298
  ZIKV (strain MR 766) Polyprotein(93-800) mRNA Design 2 wild type

SEQ ID NO: 5228 - RNA, 2524 nt, Artificial Sequence
  ZIKV (strain NatalRGN) Polyprotein(93-804) mRNA Design 2 wild type
ggggcgcugccuacggagguggcagccaucuccuucucggcaucaagcuuaccaugagaauaaucaaugcuaggaaggagaagaagagacgaggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5229 - RNA, 2449 nt, Artificial Sequence
  ZIKV (strain ZikaSPH2015) Polyprotein(108-794) mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5230 - RNA, 2449 nt, Artificial Sequence
  ZIKV (isolate Z1106033) Polyprotein(108-794) mRNA Design 2 wild type
ggggcgcugccuacggagguggcagccaucuccuucucggcaucaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5231 - RNA, 2437 nt, Artificial Sequence
  ZIKV (strain MR 766) Polyprotein(108-790) mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5232 - RNA, 2449 nt, Artificial Sequence
  ZIKV (strain NatalRGN) Polyprotein(108-794) mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5233 - RNA, 1741 nt, Artificial Sequence; identical to SEQ ID NO: 291
  ZIKV (strain ZikaSPH2015) Polyprotein(273-723) mRNA Design 2 wild type

SEQ ID NO: 5234 - RNA, 1741 nt, Artificial Sequence; identical to SEQ ID NO: 295
  ZIKV (isolate Z1106033) Polyprotein(273-723) mRNA Design 2 wild type

SEQ ID NO: 5235 - RNA, 1729 nt, Artificial Sequence; identical to SEQ ID NO: 300
  ZIKV (strain MR 766) Polyprotein(273-719) mRNA Design 2 wild type

SEQ ID NO: 5236 - RNA, 1741 nt, Artificial Sequence
  ZIKV (strain NatalRGN) Polyprotein(273-723) mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5237 - RNA, 2449 nt, Artificial Sequence
  ZIKV (strain ZikaSPH2015) Polyprotein(108-794)(F398S) mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5238 - RNA, 2449 nt, Artificial Sequence
  ZIKV (isolate Z1106033) Polyprotein(108-794)(F398S) mRNA Design 2 wild type
ggggcgcugccuacggagguggcagccaucuccuucucggcaucaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5239 - RNA, 2437 nt, Artificial Sequence
  ZIKV (strain MR 766) Polyprotein(108-790)(F398S) mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuccggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5240 - RNA, 2449 nt, Artificial Sequence
  ZIKV (strain NatalRGN) Polyprotein(108-794)(F398S) mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5241 - RNA, 2449 nt, Artificial Sequence
  ZIKV (strain ZikaSPH2015) Polyprotein(108-794)(N444Q) mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5242 - RNA, 2449 nt, Artificial Sequence
  ZIKV (isolate Z1106033) Polyprotein(108-794)(N444Q) mRNA Design 2 wild type
ggggcgcugccuacggagguggcagccaucuccuucucggcaucaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5243 - RNA, 2449 nt, Artificial Sequence
  ZIKV (strain NatalRGN) Polyprotein(108-794)(N444Q) mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5244 - RNA, 2449 nt, Artificial Sequence
  ZIKV (strain ZikaSPH2015) Polyprotein(108-694)-Cterm-JAEV1-E(400-500) mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5245 - RNA, 2449 nt, Artificial Sequence
  ZIKV (isolate Z1106033) Polyprotein(108-694)-Cterm-JAEV1-E(400-500) mRNA Design 2 wild type
ggggcgcugccuacggagguggcagccaucuccuucucggcaucaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5246 - RNA, 2437 nt, Artificial Sequence
  ZIKV (strain MR 766) Polyprotein(108-690)-Cterm-JAEV1-E(400-500) mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5247 - RNA, 2449 nt, Artificial Sequence
  ZIKV (strain NatalRGN) Polyprotein(108-694)-Cterm-JAEV1-E(400-500) mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5248 - RNA, 2524 nt, Artificial Sequence; identical to SEQ ID NO: 290
  ZIKV (strain ZikaSPH2015) Polyprotein(93-804) mRNA Design 2 wild type

SEQ ID NO: 5249 - RNA, 2521 nt, Artificial Sequence
  ZIKV prME variant mRNA Design 2 wild type
ggggcgcugccuacggagguggcagccaucuccuucucggcaucaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5250 - RNA, 2518 nt, Artificial Sequence
  ZIKV prME variant mRNA Design 2 wild type
ggggcgcugccuacggagguggcagccaucuccuucucggcaucaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5251 - RNA, 2515 nt, Artificial Sequence
  ZIKV prME variant mRNA Design 2 wild type
ggggcgcugccuacggagguggcagccaucuccuucucggcaucaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5252 - RNA, 2512 nt, Artificial Sequence
  ZIKV prME variant mRNA Design 2 wild type
ggggcgcugccuacggagguggcagccaucuccuucucggcaucaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5253 - RNA, 2509 nt, Artificial Sequence
  ZIKV prME variant mRNA Design 2 wild type
ggggcgcugccuacggagguggcagccaucuccuucucggcaucaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5254 - RNA, 2506 nt, Artificial Sequence
  ZIKV prME variant mRNA Design 2 wild type
ggggcgcugccuacggagguggcagccaucuccuucucggcaucaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5255 - RNA, 2503 nt, Artificial Sequence
  ZIKV prME variant mRNA Design 2 wild type
ggggcgcugccuacggagguggcagccaucuccuucucggcaucaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5256 - RNA, 2500 nt, Artificial Sequence
  ZIKV prME variant mRNA Design 2 wild type
ggggcgcugccuacggagguggcagccaucuccuucucggcaucaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5257 - RNA, 2497 nt, Artificial Sequence
  ZIKV prME variant mRNA Design 2 wild type
ggggcgcugccuacggagguggcagccaucuccuucucggcaucaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5258 - RNA, 2494 nt, Artificial Sequence
  ZIKV prME variant mRNA Design 2 wild type
ggggcgcugccuacggagguggcagccaucuccuucucggcaucaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5259 - RNA, 2491 nt, Artificial Sequence
  ZIKV prME variant mRNA Design 2 wild type
ggggcgcugccuacggagguggcagccaucuccuucucggcaucaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5260 - RNA, 2488 nt, Artificial Sequence
  ZIKV prME variant mRNA Design 2 wild type
ggggcgcugccuacggagguggcagccaucuccuucucggcaucaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5261 - RNA, 2485 nt, Artificial Sequence
  ZIKV prME variant mRNA Design 2 wild type
ggggcgcugccuacggagguggcagccaucuccuucucggcaucaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5262 - RNA, 2482 nt, Artificial Sequence
  ZIKV prME variant mRNA Design 2 wild type
ggggcgcugccuacggagguggcagccaucuccuucucggcaucaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5263 - RNA, 2479 nt, Artificial Sequence
  ZIKV prME variant mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5264 - RNA, 2479 nt, Artificial Sequence
  ZIKV prME variant mRNA Design 2 wild type
ggggcgcugccuacggagguggcagccaucuccuucucggcaucaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5265 - RNA, 2491 nt, Artificial Sequence
  ZIKV prME variant mRNA Design 2 wild type
ggggcgcugccuacggagguggcagccaucuccuucucggcaucaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5266 - RNA, 2515 nt, Artificial Sequence
  ZIKV prME variant mRNA Design 2 wild type
ggggcgcugccuacggagguggcagccaucuccuucucggcaucaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5267 - RNA, 2515 nt, Artificial Sequence
  ZIKV prME variant mRNA Design 2 wild type
ggggcgcugccuacggagguggcagccaucuccuucucggcaucaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5268 - RNA, 2506 nt, Artificial Sequence
  ZIKV prME variant mRNA Design 2 wild type
ggggcgcugccuacggagguggcagccaucuccuucucggcaucaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5269 - RNA, 2503 nt, Artificial Sequence
  ZIKV prME variant mRNA Design 2 wild type
ggggcgcugccuacggagguggcagccaucuccuucucggcaucaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5270 - RNA, 2500 nt, Artificial Sequence
  ZIKV prME variant mRNA Design 2 wild type
ggggcgcugccuacggagguggcagccaucuccuucucggcaucaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5271 - RNA, 2497 nt, Artificial Sequence
  ZIKV prME variant mRNA Design 2 wild type
ggggcgcugccuacggagguggcagccaucuccuucucggcaucaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5272 - RNA, 2494 nt, Artificial Sequence
  ZIKV prME variant mRNA Design 2 wild type
ggggcgcugccuacggagguggcagccaucuccuucucggcaucaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5273 - RNA, 2491 nt, Artificial Sequence
  ZIKV prME variant mRNA Design 2 wild type
ggggcgcugccuacggagguggcagccaucuccuucucggcaucaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5274 - RNA, 2488 nt, Artificial Sequence
  ZIKV prME variant mRNA Design 2 wild type
ggggcgcugccuacggagguggcagccaucuccuucucggcaucaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5275 - RNA, 2485 nt, Artificial Sequence
  ZIKV prME variant mRNA Design 2 wild type
ggggcgcugccuacggagguggcagccaucuccuucucggcaucaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5276 - RNA, 2482 nt, Artificial Sequence
  ZIKV prME variant mRNA Design 2 wild type
ggggcgcugccuacggagguggcagccaucuccuucucggcaucaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5277 - RNA, 2479 nt, Artificial Sequence
  ZIKV prME variant mRNA Design 2 wild type
ggggcgcugccuacggagguggcagccaucuccuucucggcaucaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5278 - RNA, 2476 nt, Artificial Sequence
  ZIKV prME variant mRNA Design 2 wild type
ggggcgcugccuacggagguggcagccaucuccuucucggcaucaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5279 - RNA, 2473 nt, Artificial Sequence
  ZIKV prME variant mRNA Design 2 wild type
ggggcgcugccuacggagguggcagccaucuccuucucggcaucaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5280 - RNA, 2470 nt, Artificial Sequence
  ZIKV prME variant mRNA Design 2 wild type
ggggcgcugccuacggagguggcagccaucuccuucucggcaucaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5281 - RNA, 2467 nt, Artificial Sequence
  ZIKV prME variant mRNA Design 2 wild type
ggggcgcugccuacggagguggcagccaucuccuucucggcaucaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5282 - RNA, 2464 nt, Artificial Sequence
  ZIKV prME variant mRNA Design 2 wild type
ggggcgcugccuacggagguggcagccaucuccuucucggcaucaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5283 - RNA, 2461 nt, Artificial Sequence
  ZIKV prME variant mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5284 - RNA, 2461 nt, Artificial Sequence
  ZIKV prME variant mRNA Design 2 wild type
ggggcgcugccuacggagguggcagccaucuccuucucggcaucaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5285 - RNA, 2473 nt, Artificial Sequence
  ZIKV prME variant mRNA Design 2 wild type
ggggcgcugccuacggagguggcagccaucuccuucucggcaucaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5286 - RNA, 2497 nt, Artificial Sequence
  ZIKV prME variant mRNA Design 2 wild type
ggggcgcugccuacggagguggcagccaucuccuucucggcaucaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5287 - RNA, 2497 nt, Artificial Sequence
  ZIKV prME variant mRNA Design 2 wild type
ggggcgcugccuacggagguggcagccaucuccuucucggcaucaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5288 - RNA, 2497 nt, Artificial Sequence
  ZIKV prME variant mRNA Design 2 wild type
ggggcgcugccuacggagguggcagccaucuccuucucggcaucaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5289 - RNA, 2494 nt, Artificial Sequence
  ZIKV prME variant mRNA Design 2 wild type
ggggcgcugccuacggagguggcagccaucuccuucucggcaucaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5290 - RNA, 2491 nt, Artificial Sequence
  ZIKV prME variant mRNA Design 2 wild type
ggggcgcugccuacggagguggcagccaucuccuucucggcaucaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5291 - RNA, 2488 nt, Artificial Sequence
  ZIKV prME variant mRNA Design 2 wild type
ggggcgcugccuacggagguggcagccaucuccuucucggcaucaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5292 - RNA, 2485 nt, Artificial Sequence
  ZIKV prME variant mRNA Design 2 wild type
ggggcgcugccuacggagguggcagccaucuccuucucggcaucaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5293 - RNA, 2482 nt, Artificial Sequence
  ZIKV prME variant mRNA Design 2 wild type
ggggcgcugccuacggagguggcagccaucuccuucucggcaucaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5294 - RNA, 2479 nt, Artificial Sequence
  ZIKV prME variant mRNA Design 2 wild type
ggggcgcugccuacggagguggcagccaucuccuucucggcaucaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5295 - RNA, 2476 nt, Artificial Sequence
  ZIKV prME variant mRNA Design 2 wild type
ggggcgcugccuacggagguggcagccaucuccuucucggcaucaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5296 - RNA, 2473 nt, Artificial Sequence
  ZIKV prME variant mRNA Design 2 wild type
ggggcgcugccuacggagguggcagccaucuccuucucggcaucaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5297 - RNA, 2470 nt, Artificial Sequence
  ZIKV prME variant mRNA Design 2 wild type
ggggcgcugccuacggagguggcagccaucuccuucucggcaucaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5298 - RNA, 2467 nt, Artificial Sequence
  ZIKV prME variant mRNA Design 2 wild type
ggggcgcugccuacggagguggcagccaucuccuucucggcaucaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5299 - RNA, 2464 nt, Artificial Sequence
  ZIKV prME variant mRNA Design 2 wild type
ggggcgcugccuacggagguggcagccaucuccuucucggcaucaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5300 - RNA, 2461 nt, Artificial Sequence
  ZIKV prME variant mRNA Design 2 wild type
ggggcgcugccuacggagguggcagccaucuccuucucggcaucaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5301 - RNA, 2458 nt, Artificial Sequence
  ZIKV prME variant mRNA Design 2 wild type
ggggcgcugccuacggagguggcagccaucuccuucucggcaucaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5302 - RNA, 2455 nt, Artificial Sequence
  ZIKV prME variant mRNA Design 2 wild type
ggggcgcugccuacggagguggcagccaucuccuucucggcaucaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5303 - RNA, 2452 nt, Artificial Sequence
  ZIKV prME variant mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5304 - RNA, 2452 nt, Artificial Sequence
  ZIKV prME variant mRNA Design 2 wild type
ggggcgcugccuacggagguggcagccaucuccuucucggcaucaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5305 - RNA, 2464 nt, Artificial Sequence
  ZIKV prME variant mRNA Design 2 wild type
ggggcgcugccuacggagguggcagccaucuccuucucggcaucaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5306 - RNA, 2488 nt, Artificial Sequence
  ZIKV prME variant mRNA Design 2 wild type
ggggcgcugccuacggagguggcagccaucuccuucucggcaucaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5307 - RNA, 2488 nt, Artificial Sequence
  ZIKV prME variant mRNA Design 2 wild type
ggggcgcugccuacggagguggcagccaucuccuucucggcaucaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5308 - RNA, 2494 nt, Artificial Sequence
  ZIKV prME variant mRNA Design 2 wild type
ggggcgcugccuacggagguggcagccaucuccuucucggcaucaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5309 - RNA, 2488 nt, Artificial Sequence
  ZIKV prME variant mRNA Design 2 wild type
ggggcgcugccuacggagguggcagccaucuccuucucggcaucaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5310 - RNA, 2491 nt, Artificial Sequence
  ZIKV prME variant mRNA Design 2 wild type
ggggcgcugccuacggagguggcagccaucuccuucucggcaucaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5311 - RNA, 2485 nt, Artificial Sequence
  ZIKV prME variant mRNA Design 2 wild type
ggggcgcugccuacggagguggcagccaucuccuucucggcaucaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5312 - RNA, 2482 nt, Artificial Sequence
  ZIKV prME variant mRNA Design 2 wild type
ggggcgcugccuacggagguggcagccaucuccuucucggcaucaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5313 - RNA, 2479 nt, Artificial Sequence
  ZIKV prME variant mRNA Design 2 wild type
ggggcgcugccuacggagguggcagccaucuccuucucggcaucaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5314 - RNA, 2476 nt, Artificial Sequence
  ZIKV prME variant mRNA Design 2 wild type
ggggcgcugccuacggagguggcagccaucuccuucucggcaucaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5315 - RNA, 2473 nt, Artificial Sequence
  ZIKV prME variant mRNA Design 2 wild type
ggggcgcugccuacggagguggcagccaucuccuucucggcaucaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5316 - RNA, 2470 nt, Artificial Sequence
  ZIKV prME variant mRNA Design 2 wild type
ggggcgcugccuacggagguggcagccaucuccuucucggcaucaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5317 - RNA, 2467 nt, Artificial Sequence
  ZIKV prME variant mRNA Design 2 wild type
ggggcgcugccuacggagguggcagccaucuccuucucggcaucaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5318 - RNA, 2464 nt, Artificial Sequence
  ZIKV prME variant mRNA Design 2 wild type
ggggcgcugccuacggagguggcagccaucuccuucucggcaucaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5319 - RNA, 2461 nt, Artificial Sequence
  ZIKV prME variant mRNA Design 2 wild type
ggggcgcugccuacggagguggcagccaucuccuucucggcaucaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5320 - RNA, 2458 nt, Artificial Sequence
  ZIKV prME variant mRNA Design 2 wild type
ggggcgcugccuacggagguggcagccaucuccuucucggcaucaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5321 - RNA, 2455 nt, Artificial Sequence
  ZIKV prME variant mRNA Design 2 wild type
ggggcgcugccuacggagguggcagccaucuccuucucggcaucaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5322 - RNA, 2452 nt, Artificial Sequence
  ZIKV prME variant mRNA Design 2 wild type
ggggcgcugccuacggagguggcagccaucuccuucucggcaucaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5323 - RNA, 2449 nt, Artificial Sequence; identical to SEQ ID NO: 5229
  ZIKV (strain ZikaSPH2015) Polyprotein(108-794) mRNA Design 2 wild type

SEQ ID NO: 5324 - RNA, 2449 nt, Artificial Sequence
  ZIKV prME variant mRNA Design 2 wild type
ggggcgcugccuacggagguggcagccaucuccuucucggcaucaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5325 - RNA, 2461 nt, Artificial Sequence
  ZIKV prME variant mRNA Design 2 wild type
ggggcgcugccuacggagguggcagccaucuccuucucggcaucaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5326 - RNA, 2485 nt, Artificial Sequence
  ZIKV prME variant mRNA Design 2 wild type
ggggcgcugccuacggagguggcagccaucuccuucucggcaucaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5327 - RNA, 2485 nt, Artificial Sequence
  ZIKV prME variant mRNA Design 2 wild type
ggggcgcugccuacggagguggcagccaucuccuucucggcaucaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5328 - RNA, 2524 nt, Artificial Sequence; identical to SEQ ID NO: 289
  KU321639.1 prME-long mRNA Design 2 wild type

SEQ ID NO: 5329 - RNA, 2524 nt, Artificial Sequence; identical to SEQ ID NO: 293
  KU312312.1 prME-long mRNA Design 2 wild type

SEQ ID NO: 5330 - RNA, 2512 nt, Artificial Sequence; identical to SEQ ID NO: 297
  AY632535.2 prME-long mRNA Design 2 wild type

SEQ ID NO: 5331 - RNA, 2524 nt, Artificial Sequence
  KU527068.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5332 - RNA, 2524 nt, Artificial Sequence
  KU720415.1 prME-long mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5333 - RNA, 2506 nt, Artificial Sequence
  DQ859059.1 prME-long mRNA Design 2 wild type
ggggcgcugccuacggagguggcagccaucuccuucucggcaucaagcuuaccaugagaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5334 - RNA, 2524 nt, Artificial Sequence
  KX377335.1 prME-long mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucgcaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggucuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5335 - RNA, 2524 nt, Artificial Sequence
  LC002520.1 prME-long mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5336 - RNA, 2512 nt, Artificial Sequence
  KU963573.2 prME-long mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5337 - RNA, 2524 nt, Artificial Sequence
  KX694534.2 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaggggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5338 - RNA, 2524 nt, Artificial Sequence
  KX447520.1 prME-long mRNA Design 2 wild type
ggggcgcugccuacggagguggcagccaucuccuucucggcaucaagcuuaccaugagaauaaucaaugcuaggaaggagaagaagagacgaggcgcagaugcuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5339 - RNA, 2524 nt, Artificial Sequence
  KX369547.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuagaaagcugcaaacgcggucgcaaaccugguuggaaucaagagaauacacaaagcacuugauuagagucgaaaauuggauauucaggaacccuggccucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5340 - RNA, 2524 nt, Artificial Sequence
  KX447515.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccuacugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5341 - RNA, 2524 nt, Artificial Sequence
  KU501217.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcugcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5342 - RNA, 2524 nt, Artificial Sequence
  KU312314.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5343 - RNA, 2524 nt, Artificial Sequence
  KX446950.2 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuacgcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccagcauacagcaucaggugcauaggagucagcaauagggacuuuguggaagguaugucaggugggacuuggguugauguugucuuggaacauggagguugugucaccguaauggcacaggacaaaccgacugucgacauagagcuggucacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5344 - RNA, 2524 nt, Artificial Sequence
  KY003157.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagucgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5345 - RNA, 2524 nt, Artificial Sequence
  KX811222.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucagcuuggguuguguacggaaccugccaucacaaaaaaggugaagcacggagaucuagaagagcugugacgcuccccucccauuccacuaggaagcugcaaacgcggccgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5346 - RNA, 2524 nt, Artificial Sequence
  KX447516.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaaguucaacgagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5347 - RNA, 2524 nt, Artificial Sequence
  KX520666.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5348 - RNA, 2524 nt, Artificial Sequence
  KU729218.1 prME-long mRNA Design 2 wild type
ggggcgcugccuacggagguggcagccaucuccuucucggcaucaagcuuaccaugagaauaaucaaugcuaggaaggagaagaagagacgaagcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccacuaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5349 - RNA, 2524 nt, Artificial Sequence
  KU761561.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5350 - RNA, 2524 nt, Artificial Sequence
  KY317938.1 prME-long mRNA Design 2 wild type
ggggcgcugccuacggagguggcagccaucuccuucucggcaucaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5351 - RNA, 2524 nt, Artificial Sequence
  KY075939.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5352 - RNA, 2524 nt, Artificial Sequence
  KX806557.2 prME-long mRNA Design 2 wild type
ggggcgcugccuacggagguggcagccaucuccuucucggcaucaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaacuggauguucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaaggucccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5353 - RNA, 2524 nt, Artificial Sequence
  KU870645.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugagugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauacucaggaacccuggcuucgcguuagcagcagcugccaucgcuuggcuuuugggaagcucaacgagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5354 - RNA, 2524 nt, Artificial Sequence
  KU729217.2 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5355 - RNA, 2524 nt, Artificial Sequence
  KU497555.1 prME-long mRNA Design 2 wild type
ggggcgcugccuacggagguggcagccaucuccuucucggcaucaagcuuaccaugagaauaaucaaugccaggaaggagaagaagagacgaggcgcagauacuagugucggaaucguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5356 - RNA, 2524 nt, Artificial Sequence
  KX087101.3 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5357 - RNA, 2524 nt, Artificial Sequence
  KY075932.1 prME-long mRNA Design 2 wild type
ggggcgcugccuacggagguggcagccaucuccuucucggcaucaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggauagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagaaucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugauaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5358 - RNA, 2524 nt, Artificial Sequence
  KY014317.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcgcuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucucaacucauugggcaagggcauccaucaaauuuuuggagcagcuuucaaaucauuguuuggaggaauguccugguucucacaaauucucaucggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5359 - RNA, 2524 nt, Artificial Sequence
  KU758876.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuuccuuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5360 - RNA, 2524 nt, Artificial Sequence
  KU758874.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgccuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5361 - RNA, 2524 nt, Artificial Sequence
  KY014314.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5362 - RNA, 2524 nt, Artificial Sequence
  KU926310.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucaccagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5363 - RNA, 2524 nt, Artificial Sequence
  KU761560.1 prME-long mRNA Design 2 wild type
ggggcgcugccuacggagguggcagccaucuccuucucggcaucaagcuuaccaugagaauaaucaaugcugggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacguucaccaagaucccggcugaaacacugcacgggacagucacaguggagguacaguacgcagggacagauggaccuugcaagguuccagcucagauggcgguggacaugcaaacucugaccccaguugggaggcugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5364 - RNA, 2524 nt, Artificial Sequence
  KY317939.1 prME-long mRNA Design 2 wild type
ggggcgcugccuacggagguggcagccaucuccuucucggcaucaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaaagaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcauaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5365 - RNA, 2524 nt, Artificial Sequence
  KY075937.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcagaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggagugcugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5366 - RNA, 2524 nt, Artificial Sequence
  LC191864.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacaugacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugaccugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguccacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggagugguagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaacggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5367 - RNA, 2524 nt, Artificial Sequence
  KX447517.1 prME-long mRNA Design 2 wild type
ggggcgcugccuacggagguggcagccaucuccuucucggcaucaagcuuaccaugagaauaaucaaugccaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugcgaugccaccaugagcuaugaaugcccuaugcuggaugaggggguggaaccagaugacgucgauuguuggugcaauacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaacucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5368 - RNA, 2524 nt, Artificial Sequence
  KU922923.1 prME-long mRNA Design 2 wild type
ggggcgcugccuacggagguggcagccaucuccuucucggcaucaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcguggcuuuugggaagcucaacgagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5369 - RNA, 2524 nt, Artificial Sequence
  KY003156.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccauagcuuggcuuuugggaagcucaacgagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5370 - RNA, 2524 nt, Artificial Sequence
  KU312313.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaagucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccauuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcaugggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5371 - RNA, 2524 nt, Artificial Sequence
  KY075935.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuucccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacagagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaaguuauauacuuggucaugauacugcugauugccccggcauacagcaucaggugcauaggagucagcaauagggacuuuguggaagguaugucaggugggacuuggguugauguugucuuggaacauggaggcugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacccaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagauacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5372 - RNA, 2524 nt, Artificial Sequence
  KY014320.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugccggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaagcgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacuguugacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagcuuggugacaugcgcuaaguuugcaugcuccaagaagaugaccgggaagagcauccagccagagaauuuggaguaccggauaaugcugucaguucauggcucccagcacagugggaugaucguuaaugacacaggacaugaaacugaugagaacagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaagagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucuuaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5373 - RNA, 2524 nt, Artificial Sequence
  KX827309.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcagaccugguuggagucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagauacccaauaugucugcaaaagaacguuaguggacagaggcuggggaaauggauguggacuuuuuggaaaagggagccuggugacaugcgcuaaguuugcaugcuccaagaaaaugaccgggaagagcauccagccagagaaucuggaguaccggauaaugcugucaguccauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggacaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggccugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5374 - RNA, 2524 nt, Artificial Sequence
  KU681081.3 prME-long mRNA Design 2 wild type
ggggcgcugccuacggagguggcagccaucuccuucucggcaucaagcuuaccaugagaauaaucaaugcuaggaaggagaagaagagacgaggcacagauacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagauccagaagagcugugacgcuccccucccauuccacuaggaagcugcaaacgcggucgcagaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcguucuuaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucuccgcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5375 - RNA, 2524 nt, Artificial Sequence
  KU744693.1 prME-long mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcucccuucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuauuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucaggugguguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5376 - RNA, 2524 nt, Artificial Sequence
  KY328290.1 prME-long mRNA Design 2 wild type
ggggcgcugccuacggagguggcagccaucuccuucucggcaucaagcuuaccaugagaauaaucaaugcuaggaaggagaagaagagacgaggcacagauacuagugucggaauuguuggccuccugcugaccacagccauggcagcggaagucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5377 - RNA, 2524 nt, Artificial Sequence
  KX694532.2 prME-long mRNA Design 2 wild type
ggggcgcugccuacggagguggcagccaucuccuucucggcaucaagcuuaccaugagaauaaucaaugccaggaaggagaagaagagacgaggcacagacacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuagcagcagcugccaucgcuuggcucuugggaagcucaacgagccaaaaagucauauacuuggucaugauacugcugauugcuccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggcgaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaauucaaggaugcacaugccaaaaggcaaacugucgugguucuagggagucaagagggagcaguucacacggcccuugcuggagcucuggaggcugagauggauggugcaaagggaaggcuguccucuggccacuugaaaugucgccugaaaauggauaaacuuagauugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5378 - RNA, 2524 nt, Artificial Sequence
  KU955593.1 prME-long mRNA Design 2 wild type
ggggcgcugccuacggagguggcagccaucuccuucucggcaucaagcuuaccaugagaauaaucaaugcuaggaaggagaagaagagacgaggcacagauacuagugucggaauuguuggccuccugcugaccacagccauggcaguggaggucacuagacgugggaaugcauacuauauguacuuggacagaagcgaugcuggggaggccauaucuuuuccaaccacaauggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcaccugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcuugcucuaagaaaaugaccgggaagagcauccagccagagaaucuggaguaccggauaaugcugucaguucauggcucccagcacagugggaugaucguuaaugauacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacacuggaacaacaaagaagcacugguagaguucaaggacgcacaugccaaaaggcagacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacuccaagaugaugcuggaacuggauccaccauuuggggacucuuacauugucauaggagucggggaaaagaagaucacccaccacuggcacaggaguggcagcaccauuggaaaagcauuugaagccacugugagaggugccaagagaauggcagucuugggagacacagccugggacuuuggaucaguugggggugcucucaacucacugggcaagggcauccaucaaauuuuuggagcagcuuucaaaucauuguuuggaggaauguccugguucucacaaauucucauuggaacguugcuggugugguugggucugaauacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5379 - RNA, 2524 nt, Artificial Sequence
  KY272987.1 prME-long mRNA Design 2 wild type
ggggcgcugccuacggagguggcagccaucuccuucucggcaucaagcuuaccaugagaauaaucaaugcuaggaaggaaaagaagagacgaggcacagacacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5380 - RNA, 2524 nt, Artificial Sequence
  EU545988.1 prME-long mRNA Design 2 wild type
ggggcgcugccuacggagguggcagccaucuccuucucggcaucaagcuuaccaugagaauaaucaaugcuaggaaggagaagaagagacgaggcacagauacuagugucggaauuguuggccuccugcugaccacagccauggcaguggaggucacuagacgugggagugcauacuauauguacuuggacagaagcgaugcuggggaggccauaucuuuuccaaccacacuggggaugaacaaguguuacauacagaucauggaucuuggacacaugugugaugccaccaugagcuaugaaugcccuauguuggaugaggggguagaaccagaugacgucgauuguuggugcaacacgacaucaacuuggguuguguacggaaccugccaccacaaaaaaggugaagcacggagaucuagaagagcugugacgcuccccucccauuccacuaggaagcugcaaacgcggucgcagaccugguuggaaucaagagaauauacaaagcaccugauuagagucgaaaauuggauauucaggaacccuggcuucgcguuagcagcagcugccaucgccuggcuuuugggaaguucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaguuggaggugcucucaacucauugggcaagggcauccaucaaauuuuuggagcagcuuucaaaucauuguuuggaggaauguccugguucucacaaauucucauuggaacguugcuggugugguugggucugaauacaaagaauggaucuauuucccuuacgugcuuggccuuagggggaguguugaucuuuuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5381 - RNA, 2524 nt, Artificial Sequence
  KU681082.3 prME-long mRNA Design 2 wild type
ggggcgcugccuacggagguggcagccaucuccuucucggcaucaagcuuaccaugagaauaaucaaugcuaggaaggagaagaagagacgaggcgcagauacuagcgucggaauuguuggccuccuccugaccacagccauggcaguagaggucacuagacgugggagugcauacuauauguacuuggacagaagcgaugcuggggaggccauaucuuuuccaaccacacuggggaugaauaaguguuacauacaaaucauggaucuuggacacaugugugaugccaccaugagcuaugaaugcccuauguuggaugaggggguagaaccagaugacgucgauugcuggugcaacacgacaucaacuuggguuguguauggaaccugccaccacaaaaaaggugaagcacggagaucuagaagagcugugacgcuccccucccauuccacuaggaagcugcaaacgcggucgcagaccugguuggaaucaagagaauacacaaagcaccugauuagaguugaaaauuggauauucaggaacccuggcuucgcguuagcagcagcugucaucgcuuggcuuuugggaaguucaacgagccaaaaagucauauaucuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggauauggcuucggacagccgcugcccaacacaaggugaggccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuugggagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugcaaaaaggcaaacugucgugguucuagggagucaagaaggagcaguucacacggcccuugcuggagcucuggaggcugagauggauggagccaagggaaggcuguccucuggccacuugaaaugucgccugaaaauggauaaacuuagauugaagggcgugucauacuccuugugcacugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggacuuuggaucaguugggggugcucucaacucauugggcaagggcauccaucaaauuuuuggagcagcuuucaaaucauuguucggaggaauguccugguucucacaaauucucauuggaacguugcuggugugguugggucugaauacaaagaauggaucuauuucccuuacgugcuuggccuuagggggaguguugaucuucuuauccacagccguuucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5382 - RNA, 2524 nt, Artificial Sequence
  KX601167.1 prME-long mRNA Design 2 wild type
ggggcgcugccuacggagguggcagccaucuccuucucggcaucaagcuuaccaugagaauaaucaaugcuaggaaggagaagaagagacguggcgcagacaccagugucggaauuguuggccuccugcugaccacagccauggcaguggaggucaccagacgugggagugcauacuauauguacuuagacagaagcgaugcuggggaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcugaugugggguguucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5383 - RNA, 2524 nt, Artificial Sequence
  KX694533.2 prME-long mRNA Design 2 wild type
ggggcgcugccuacggagguggcagccaucuccuucucggcaucaagcuuaccaugagaauaaucaaugcuaggaaggagaagaagagacguggcgcagacaccagugucggaauuguuggccuccugcugaccacagccauggcaguggaggucaccagacgugggagugcauacuauauguacuuagacagaagcgaugcugggaaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcugaugugggguguucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5384 - RNA, 2524 nt, Artificial Sequence
  KY288905.1 prME-long mRNA Design 2 wild type
ggggcgcugccuacggagguggcagccaucuccuucucggcaucaagcuuaccaugagaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5385 - RNA, 2524 nt, Artificial Sequence
  KF268950.1 prME-long mRNA Design 2 wild type
ggggcgcugccuacggagguggcagccaucuccuucucggcaucaagcuuaccaugagaauaaucaaugcuaggaaggagaggaagagacguggugcagacaccagcaucggaaucauuggucuccugcugacuacagccauggcagcggagauuaccagacguggaagugcauacuacauguacuuggacaggagcgaugcugggaaggccaucuccuuugcuaccaacuugggaguuaacaaaugccauguacagaucauggaucucgggcacaugugugacgccaccaugaguuaugagugcccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaaguugcaaacgcggucgcagaccugguuagaaucaagagaauacacgaagcaccugaucaagguugaaaacuggauauuuaggaaccccggguuugcgcucgcagcuguugccauugccuggcuuuugggaagcucgacgagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucagucgggggcguguucaacucauugggcaaggguguucaccagauuuuuggagcagcuuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcugacguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5386 - RNA, 2524 nt, Artificial Sequence
  KF383121.1 prME-long mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaaugguuguggacuuuuuggcaaagggagcuuggugacaugugccaaguucacguguucuaagaagaugaccgggaagagcauucaaccggaaaaucuggaguaucggauaaugcuaucagugcauggcucccagcauagcgggaugauugucaaugauauaggacaugaaacugacgaaaacagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5387 - RNA, 2506 nt, Artificial Sequence
  KF268949.1 prME-long mRNA Design 2 wild type
ggggcgcugccuacggagguggcagccaucuccuucucggcaucaagcuuaccaugagaauaaucaaugcuaggaaggagaggaagagacguggugcagacaccagcaucggaaucauuggucuccugcugacuacagccauggcagcagagauuaccagacguggaagugcauacuacauguacuuggacaggagcgaugcugggaaggccaucuccuuugcuaccaauuugggaguuaacaaaugccauguacagaucauggaucucgggcacaugugugacgccaccaugaguuaugaguguccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaagcugcaaacgcggucgcagacuugguuagaaucaagagaauacacgaagcacuugaucaagguugaaaacuggauauucaggaaccccggguuugcgcucgcagcuguugccauugccuggcuuuugggaagcucgacgagccaaaaagucauauacuuggucaugauacugcugauugccccggcauacagcaucaggugcauuggagucagcaauagagacuucguggaaggcaugucaggugggaccuggguugaugucgucuuggaacauggagguugcgucaccguaauggcacaggacaagccaacaguugacauagaguuggucacgacaacggucaguaacauggccgagguaagauccuacuguuaugaggcaucaauaucggacauggcuucggacagucgcugcccaacacaaggugaagccuaccuugacaagcaaucagacacucaauauguaugcaaaagaacauugguggacagagguuggggaaauggguguggacuuuuuggcaaagggagccuggugacaugugccaaguucacguguuccaagaagaugaccgggaagagcauucagccggagaaucuggaguaucgaauaaugcuaucagugcauggcucccagcacagcgggaugauuguuaaugacgaaaauagggcgaaagucgaggucacgcccaauucaccaagagcagaagcaaccuugggaggcuuuggaagcuuaggacuugauugugaaccaaggacaggccuggacuuuucagauuuguacuacuugaccaugaacaauaagcacugguuagugcacaaagagugguuucaugacaucccauugcccuggcaugcuggggcagacaccggaacuccacauuggaacaacaaggaggcauugguagaguucaaagaugcccacgcuaagaggcaaaccgucguuguucuagggagccaggaaggagccguucacacggcucuugcuggagcucuggaggcugagauggauggugcaaaaggaagguuguucuccggccauuugaaaugccgcuuaaaaauggacaagcuuagauugaagggcgugucauauuccuugugcaccgcagcguucacauucaccaaggucccagcugaaacauugcauggaacaguuacaguggaggugcaguaugcagggacagauggacccugcaaggucccagcucagauggcgguggacaugcagacccugaccccagucggaaggcugauaaccgccaaccccgugauuacugaaagcacugagaauucaaagaugauguuggagcucgacccaccauuuggggauucuuacauugucauaggaguuggggacaagaaaauuacccaccacuggcauaggagugguagcaccaucggaaaagcauuugaggccacugugagaggugccaagagaauggcaguucugggggacacagccugggacuuuggaucagucgggggcguguuuaacucauugggcaagggcauccaccagauuuuuggagcagccuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcugacguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5388 - RNA, 2524 nt, Artificial Sequence
  KU955595.1 prME-long mRNA Design 2 wild type
ggggcgcugccuacggagguggcagccaucuccuucucggcaucaagcuuaccaugagaauuaucaaugcuaggaaggagaggaagagacguggcgcugacaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacacaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuacuugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcugauguugggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5389 - RNA, 2524 nt, Artificial Sequence
  KF383116.1 prME-long mRNA Design 2 wild type
ggggcgcugccuacggagguggcagccaucuccuucucggcaucaagcuuaccaugagaauuaucaaugcuaggaaggagaggaagagacguggcgcugacaccagcaucggaaucgucggccuccugcugaccacagccauggcagccgagaucaccagacgugggagugcauacuacauguacuuggacaggagcgaugcugguaaggccauuucuuuugcuaccacauugggggugaacaaaugccauguacagaucauggaccucgggcacaugugugacgccaccaugaguuaugagugccccaugcuggacgagggaguggagccagaugacgucgauugcuggugcaacacgacaucaacuuggguuguguacggaaccugucaacauaaaaaaggugaagcacgacgauccagaagagccgugacgcuuccuucucacuccacaaggaagcugcaaacgcgaucacagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuuuaaaucacuguuuggaggaauguccugguucucacagauccucauaggcacacuguuggugugguuaggucugaacacaaagaauggaucuaucucccucacaugcuuagcccuggggggagugaugaucuuccuuuccacggcuguuucugcugauguugggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5390 - RNA, 2506 nt, Artificial Sequence
  KU963574.2 prME-long mRNA Design 2 wild type
ggggcgcugccuacggagguggcagccaucuccuucucggcaucaagcuuaccaugagaauaaucaaugcuaggaaggagaggaagagacguggagcugaugccagcaucggaaucgucagccuccugcugacuacagucauggcagcagagaucacuagacgcgggagugcauacuacauguacuuggacaggagcgaugcugguaaggccauuucuuucguuaccacacugggggugaacaaaugccaugugcagaucauggaccucgggcauaugugugacgccaccaugaguuaugagugccccaugcuggacgagggaguggagccagaugacgucgauugcuggugcaacacgacaucaacuuggguuguguacggaaccugucaucauaaaaaaggugaagcacgacgauccagaagagccgugacgcuuccuucucacucuacaaggaaguugcaaacgcgaucgcagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaguuggggguguguuuaacucauugggcaaggguauucaccagaucuuuggagcagcuuucaaaucacuguucggaggaauguccugguucucacagauccucauaggcacacuguuggugugguugggucugaacacaaagaauggaucuaucucccucacaugcuuggccuugggaggagugaugaucuuccuuuccacggcuguuucugcugaugugggguguucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5391 - RNA, 2506 nt, Artificial Sequence
  KX601166.1 prME-long mRNA Design 2 wild type
ggggcgcugccuacggagguggcagccaucuccuucucggcaucaagcuuaccaugagaauuaucaaugcuaggaaggagaggaagagacguggcgcugacaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcugauguugggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5392 - RNA, 2524 nt, Artificial Sequence
  KF383118.1 prME-long mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugagacacggcgaucuagaagaucugugucgcuccguuaucacuauacaaggaaguugcaaacgcggucgcagacaugguuagaaucaagagaauacaagaagcacuugaucauggucgaaaacuggauauucaggaaccccggguuugccauaguguccguugccauuaccuggcugaugggaagcuugacgagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5393 - RNA, 2518 nt, Artificial Sequence
  KF383120.1 prME-long mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacaaugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcccucaagaagagcugucacgcuuccuucccauuccacaagaaaguuacagacacggucacaaaccuggcuugaaucacgggaguacacgaagcaccugaucaaaguugagaacuggauacuccggaauccaggguucacaguugcugcucuagcaauggccuggcucuugggaaauuccacgagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuguuggaggcguguucaauucucugggcaagggaguucaucaggucuucggagcagccuuuaaauccuuauuuggcggaauguccugguuuucacaaauucuuauuggcacacuuuuagugugguugggcuugaauacaaaaaauggauccauuucccuugcaugucuggcgcuuggaggggcgaugaucuuucucuccacggccgucucggcagacguggggugcucaguugacuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5394 - RNA, 2449 nt, Artificial Sequence
  KU321639.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5395 - RNA, 2449 nt, Artificial Sequence
  KU312312.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5396 - RNA, 2437 nt, Artificial Sequence
  AY632535.2 prME-short mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5397 - RNA, 2449 nt, Artificial Sequence
  KU527068.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5398 - RNA, 2449 nt, Artificial Sequence
  KX421193.1 prME-short mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5399 - RNA, 2449 nt, Artificial Sequence
  KX377335.1 prME-short mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucgcaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggucuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5400 - RNA, 2449 nt, Artificial Sequence
  LC002520.1 prME-short mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5401 - RNA, 2431 nt, Artificial Sequence
  DQ859059.1 prME-short mRNA Design 2 wild type
ggggcgcugccuacggagguggcagccaucuccuucucggcaucaagcuuaccaugaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5402 - RNA, 2437 nt, Artificial Sequence
  KU963573.2 prME-short mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5403 - RNA, 2449 nt, Artificial Sequence
  KX694534.2 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaggggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5404 - RNA, 2449 nt, Artificial Sequence
  KX369547.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuagaaagcugcaaacgcggucgcaaaccugguuggaaucaagagaauacacaaagcacuugauuagagucgaaaauuggauauucaggaacccuggccucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5405 - RNA, 2449 nt, Artificial Sequence
  KX447515.1 prME-short mRNA Design 2 wild type
ggggcgcugccuacggagguggcagccaucuccuucucggcaucaagcuuaccaugacuagugucggaauuguuggccuccuacugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5406 - RNA, 2449 nt, Artificial Sequence
  KU729218.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccacuaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5407 - RNA, 2449 nt, Artificial Sequence
  KU501217.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcugcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5408 - RNA, 2449 nt, Artificial Sequence
  KU312314.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5409 - RNA, 2449 nt, Artificial Sequence
  KX446950.2 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuacgcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccagcauacagcaucaggugcauaggagucagcaauagggacuuuguggaagguaugucaggugggacuuggguugauguugucuuggaacauggagguugugucaccguaauggcacaggacaaaccgacugucgacauagagcuggucacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5410 - RNA, 2449 nt, Artificial Sequence
  KY003157.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagucgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5411 - RNA, 2449 nt, Artificial Sequence
  KX811222.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucagcuuggguuguguacggaaccugccaucacaaaaaaggugaagcacggagaucuagaagagcugugacgcuccccucccauuccacuaggaagcugcaaacgcggccgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5412 - RNA, 2449 nt, Artificial Sequence
  KX447516.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaaguucaacgagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5413 - RNA, 2449 nt, Artificial Sequence
  KX520666.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5414 - RNA, 2449 nt, Artificial Sequence
  KU497555.1 prME-short mRNA Design 2 wild type
ggggcgcugccuacggagguggcagccaucuccuucucggcaucaagcuuaccaugacuagugucggaaucguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5415 - RNA, 2449 nt, Artificial Sequence
  KY075939.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5416 - RNA, 2449 nt, Artificial Sequence
  KY075932.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggauagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagaaucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugauaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5417 - RNA, 2449 nt, Artificial Sequence
  KU870645.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugagugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauacucaggaacccuggcuucgcguuagcagcagcugccaucgcuuggcuuuugggaagcucaacgagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5418 - RNA, 2449 nt, Artificial Sequence
  KU729217.2 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5419 - RNA, 2449 nt, Artificial Sequence
  KX087101.3 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5420 - RNA, 2449 nt, Artificial Sequence
  KY014317.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcgcuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucucaacucauugggcaagggcauccaucaaauuuuuggagcagcuuucaaaucauuguuuggaggaauguccugguucucacaaauucucaucggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5421 - RNA, 2449 nt, Artificial Sequence
  KU758876.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuuccuuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5422 - RNA, 2449 nt, Artificial Sequence
  KU758874.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgccuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5423 - RNA, 2449 nt, Artificial Sequence
  KY317939.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaaagaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcauaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5424 - RNA, 2449 nt, Artificial Sequence
  KY014314.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5425 - RNA, 2449 nt, Artificial Sequence
  KX447517.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugcgaugccaccaugagcuaugaaugcccuaugcuggaugaggggguggaaccagaugacgucgauuguuggugcaauacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaacucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5426 - RNA, 2449 nt, Artificial Sequence
  KU926310.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucaccagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5427 - RNA, 2449 nt, Artificial Sequence
  KU922923.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcguggcuuuugggaagcucaacgagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5428 - RNA, 2449 nt, Artificial Sequence
  KY075937.1 prME-short mRNA Design 2 wild type
ggggcgcugccuacggagguggcagccaucuccuucucggcaucaagcuuaccaugacuagugucggaauuguuggccuccugcugaccacagcuauggcagcagaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggagugcugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5429 - RNA, 2449 nt, Artificial Sequence
  KY003156.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccauagcuuggcuuuugggaagcucaacgagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5430 - RNA, 2449 nt, Artificial Sequence
  KU312313.1 prME-short mRNA Design 2 wild type
ggggcgcugccuacggagguggcagccaucuccuucucggcaucaagcuuaccaugacuagugucggaauuguuggccuccugcugaccacagcuauggcagcggaagucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccauuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcaugggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5431 - RNA, 2449 nt, Artificial Sequence
  KY075935.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuacauguacuuggacagaaacgaugcuggggaggccauaucuuucccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacagagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaaguuauauacuuggucaugauacugcugauugccccggcauacagcaucaggugcauaggagucagcaauagggacuuuguggaagguaugucaggugggacuuggguugauguugucuuggaacauggaggcugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacccaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagauacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5432 - RNA, 2449 nt, Artificial Sequence
  KY014320.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugccggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaagcgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacuguugacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagcuuggugacaugcgcuaaguuugcaugcuccaagaagaugaccgggaagagcauccagccagagaauuuggaguaccggauaaugcugucaguucauggcucccagcacagugggaugaucguuaaugacacaggacaugaaacugaugagaacagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaagagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucuuaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5433 - RNA, 2449 nt, Artificial Sequence
  KY328290.1 prME-short mRNA Design 2 wild type
ggggcgcugccuacggagguggcagccaucuccuucucggcaucaagcuuaccaugacuagugucggaauuguuggccuccugcugaccacagccauggcagcggaagucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5434 - RNA, 2449 nt, Artificial Sequence
  KU681081.3 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagauccagaagagcugugacgcuccccucccauuccacuaggaagcugcaaacgcggucgcagaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcguucuuaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucuccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5435 - RNA, 2449 nt, Artificial Sequence
  KX827309.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcagaccugguuggagucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagauacccaauaugucugcaaaagaacguuaguggacagaggcuggggaaauggauguggacuuuuuggaaaagggagccuggugacaugcgcuaaguuugcaugcuccaagaaaaugaccgggaagagcauccagccagagaaucuggaguaccggauaaugcugucaguccauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggacaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggccugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5436 - RNA, 2449 nt, Artificial Sequence
  KU955593.1 prME-short mRNA Design 2 wild type
ggggcgcugccuacggagguggcagccaucuccuucucggcaucaagcuuaccaugacuagugucggaauuguuggccuccugcugaccacagccauggcaguggaggucacuagacgugggaaugcauacuauauguacuuggacagaagcgaugcuggggaggccauaucuuuuccaaccacaauggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcaccugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcuugcucuaagaaaaugaccgggaagagcauccagccagagaaucuggaguaccggauaaugcugucaguucauggcucccagcacagugggaugaucguuaaugauacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacacuggaacaacaaagaagcacugguagaguucaaggacgcacaugccaaaaggcagacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacuccaagaugaugcuggaacuggauccaccauuuggggacucuuacauugucauaggagucggggaaaagaagaucacccaccacuggcacaggaguggcagcaccauuggaaaagcauuugaagccacugugagaggugccaagagaauggcagucuugggagacacagccugggacuuuggaucaguugggggugcucucaacucacugggcaagggcauccaucaaauuuuuggagcagcuuucaaaucauuguuuggaggaauguccugguucucacaaauucucauuggaacguugcuggugugguugggucugaauacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5437 - RNA, 2449 nt, Artificial Sequence
  KY272987.1 prME-short mRNA Design 2 wild type
ggggcgcugccuacggagguggcagccaucuccuucucggcaucaagcuuaccaugacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5438 - RNA, 2449 nt, Artificial Sequence
  KY007221.1 prME-short mRNA Design 2 wild type
ggggcgcugccuacggagguggcagccaucuccuucucggcaucaagcuuaccaugacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucaacaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5439 - RNA, 2449 nt, Artificial Sequence
  EU545988.1 prME-short mRNA Design 2 wild type
ggggcgcugccuacggagguggcagccaucuccuucucggcaucaagcuuaccaugacuagugucggaauuguuggccuccugcugaccacagccauggcaguggaggucacuagacgugggagugcauacuauauguacuuggacagaagcgaugcuggggaggccauaucuuuuccaaccacacuggggaugaacaaguguuacauacagaucauggaucuuggacacaugugugaugccaccaugagcuaugaaugcccuauguuggaugaggggguagaaccagaugacgucgauuguuggugcaacacgacaucaacuuggguuguguacggaaccugccaccacaaaaaaggugaagcacggagaucuagaagagcugugacgcuccccucccauuccacuaggaagcugcaaacgcggucgcagaccugguuggaaucaagagaauauacaaagcaccugauuagagucgaaaauuggauauucaggaacccuggcuucgcguuagcagcagcugccaucgccuggcuuuugggaaguucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaguuggaggugcucucaacucauugggcaagggcauccaucaaauuuuuggagcagcuuucaaaucauuguuuggaggaauguccugguucucacaaauucucauuggaacguugcuggugugguugggucugaauacaaagaauggaucuauuucccuuacgugcuuggccuuagggggaguguugaucuuuuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5440 - RNA, 2449 nt, Artificial Sequence
  KU681082.3 prME-short mRNA Design 2 wild type
ggggcgcugccuacggagguggcagccaucuccuucucggcaucaagcuuaccaugacuagcgucggaauuguuggccuccuccugaccacagccauggcaguagaggucacuagacgugggagugcauacuauauguacuuggacagaagcgaugcuggggaggccauaucuuuuccaaccacacuggggaugaauaaguguuacauacaaaucauggaucuuggacacaugugugaugccaccaugagcuaugaaugcccuauguuggaugaggggguagaaccagaugacgucgauugcuggugcaacacgacaucaacuuggguuguguauggaaccugccaccacaaaaaaggugaagcacggagaucuagaagagcugugacgcuccccucccauuccacuaggaagcugcaaacgcggucgcagaccugguuggaaucaagagaauacacaaagcaccugauuagaguugaaaauuggauauucaggaacccuggcuucgcguuagcagcagcugucaucgcuuggcuuuugggaaguucaacgagccaaaaagucauauaucuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggauauggcuucggacagccgcugcccaacacaaggugaggccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuugggagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugcaaaaaggcaaacugucgugguucuagggagucaagaaggagcaguucacacggcccuugcuggagcucuggaggcugagauggauggagccaagggaaggcuguccucuggccacuugaaaugucgccugaaaauggauaaacuuagauugaagggcgugucauacuccuugugcacugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggacuuuggaucaguugggggugcucucaacucauugggcaagggcauccaucaaauuuuuggagcagcuuucaaaucauuguucggaggaauguccugguucucacaaauucucauuggaacguugcuggugugguugggucugaauacaaagaauggaucuauuucccuuacgugcuuggccuuagggggaguguugaucuucuuauccacagccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5441 - RNA, 2449 nt, Artificial Sequence
  KX601167.1 prME-short mRNA Design 2 wild type
ggggcgcugccuacggagguggcagccaucuccuucucggcaucaagcuuaccaugaccagugucggaauuguuggccuccugcugaccacagccauggcaguggaggucaccagacgugggagugcauacuauauguacuuagacagaagcgaugcuggggaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5442 - RNA, 2449 nt, Artificial Sequence
  KX694533.2 prME-short mRNA Design 2 wild type
ggggcgcugccuacggagguggcagccaucuccuucucggcaucaagcuuaccaugaccagugucggaauuguuggccuccugcugaccacagccauggcaguggaggucaccagacgugggagugcauacuauauguacuuagacagaagcgaugcugggaaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5443 - RNA, 2449 nt, Artificial Sequence
  KY288905.1 prME-short mRNA Design 2 wild type
ggggcgcugccuacggagguggcagccaucuccuucucggcaucaagcuuaccaugaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5444 - RNA, 2449 nt, Artificial Sequence
  KF268950.1 prME-short mRNA Design 2 wild type
ggggcgcugccuacggagguggcagccaucuccuucucggcaucaagcuuaccaugaccagcaucggaaucauuggucuccugcugacuacagccauggcagcggagauuaccagacguggaagugcauacuacauguacuuggacaggagcgaugcugggaaggccaucuccuuugcuaccaacuugggaguuaacaaaugccauguacagaucauggaucucgggcacaugugugacgccaccaugaguuaugagugcccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaaguugcaaacgcggucgcagaccugguuagaaucaagagaauacacgaagcaccugaucaagguugaaaacuggauauuuaggaaccccggguuugcgcucgcagcuguugccauugccuggcuuuugggaagcucgacgagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucagucgggggcguguucaacucauugggcaaggguguucaccagauuuuuggagcagcuuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5445 - RNA, 2449 nt, Artificial Sequence
  KF383121.1 prME-short mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaaugguuguggacuuuuuggcaaagggagcuuggugacaugugccaaguucacguguucuaagaagaugaccgggaagagcauucaaccggaaaaucuggaguaucggauaaugcuaucagugcauggcucccagcauagcgggaugauugucaaugauauaggacaugaaacugacgaaaacagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5446 - RNA, 2431 nt, Artificial Sequence
  KF268949.1 prME-short mRNA Design 2 wild type
ggggcgcugccuacggagguggcagccaucuccuucucggcaucaagcuuaccaugaccagcaucggaaucauuggucuccugcugacuacagccauggcagcagagauuaccagacguggaagugcauacuacauguacuuggacaggagcgaugcugggaaggccaucuccuuugcuaccaauuugggaguuaacaaaugccauguacagaucauggaucucgggcacaugugugacgccaccaugaguuaugaguguccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaagcugcaaacgcggucgcagacuugguuagaaucaagagaauacacgaagcacuugaucaagguugaaaacuggauauucaggaaccccggguuugcgcucgcagcuguugccauugccuggcuuuugggaagcucgacgagccaaaaagucauauacuuggucaugauacugcugauugccccggcauacagcaucaggugcauuggagucagcaauagagacuucguggaaggcaugucaggugggaccuggguugaugucgucuuggaacauggagguugcgucaccguaauggcacaggacaagccaacaguugacauagaguuggucacgacaacggucaguaacauggccgagguaagauccuacuguuaugaggcaucaauaucggacauggcuucggacagucgcugcccaacacaaggugaagccuaccuugacaagcaaucagacacucaauauguaugcaaaagaacauugguggacagagguuggggaaauggguguggacuuuuuggcaaagggagccuggugacaugugccaaguucacguguuccaagaagaugaccgggaagagcauucagccggagaaucuggaguaucgaauaaugcuaucagugcauggcucccagcacagcgggaugauuguuaaugacgaaaauagggcgaaagucgaggucacgcccaauucaccaagagcagaagcaaccuugggaggcuuuggaagcuuaggacuugauugugaaccaaggacaggccuggacuuuucagauuuguacuacuugaccaugaacaauaagcacugguuagugcacaaagagugguuucaugacaucccauugcccuggcaugcuggggcagacaccggaacuccacauuggaacaacaaggaggcauugguagaguucaaagaugcccacgcuaagaggcaaaccgucguuguucuagggagccaggaaggagccguucacacggcucuugcuggagcucuggaggcugagauggauggugcaaaaggaagguuguucuccggccauuugaaaugccgcuuaaaaauggacaagcuuagauugaagggcgugucauauuccuugugcaccgcagcguucacauucaccaaggucccagcugaaacauugcauggaacaguuacaguggaggugcaguaugcagggacagauggacccugcaaggucccagcucagauggcgguggacaugcagacccugaccccagucggaaggcugauaaccgccaaccccgugauuacugaaagcacugagaauucaaagaugauguuggagcucgacccaccauuuggggauucuuacauugucauaggaguuggggacaagaaaauuacccaccacuggcauaggagugguagcaccaucggaaaagcauuugaggccacugugagaggugccaagagaauggcaguucugggggacacagccugggacuuuggaucagucgggggcguguuuaacucauugggcaagggcauccaccagauuuuuggagcagccuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5447 - RNA, 2449 nt, Artificial Sequence
  KU955595.1 prME-short mRNA Design 2 wild type
ggggcgcugccuacggagguggcagccaucuccuucucggcaucaagcuuaccaugaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacacaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuacuugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5448 - RNA, 2449 nt, Artificial Sequence
  KF383116.1 prME-short mRNA Design 2 wild type
ggggcgcugccuacggagguggcagccaucuccuucucggcaucaagcuuaccaugaccagcaucggaaucgucggccuccugcugaccacagccauggcagccgagaucaccagacgugggagugcauacuacauguacuuggacaggagcgaugcugguaaggccauuucuuuugcuaccacauugggggugaacaaaugccauguacagaucauggaccucgggcacaugugugacgccaccaugaguuaugagugccccaugcuggacgagggaguggagccagaugacgucgauugcuggugcaacacgacaucaacuuggguuguguacggaaccugucaacauaaaaaaggugaagcacgacgauccagaagagccgugacgcuuccuucucacuccacaaggaagcugcaaacgcgaucacagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuuuaaaucacuguuuggaggaauguccugguucucacagauccucauaggcacacuguuggugugguuaggucugaacacaaagaauggaucuaucucccucacaugcuuagcccuggggggagugaugaucuuccuuuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5449 - RNA, 2431 nt, Artificial Sequence
  KX601166.1 prME-short mRNA Design 2 wild type
ggggcgcugccuacggagguggcagccaucuccuucucggcaucaagcuuaccaugaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5450 - RNA, 2449 nt, Artificial Sequence
  KF383118.1 prME-short mRNA Design 2 wild type
ggggcgcugccuacggagguggcagccaucuccuucucggcaucaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugagacacggcgaucuagaagaucugugucgcuccguuaucacuauacaaggaaguugcaaacgcggucgcagacaugguuagaaucaagagaauacaagaagcacuugaucauggucgaaaacuggauauucaggaaccccggguuugccauaguguccguugccauuaccuggcugaugggaagcuugacgagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5451 - RNA, 2446 nt, Artificial Sequence
  KX447520.1 prME-short mRNA Design 2 wild type
ggggcgcugccuacggagguggcagccaucuccuucucggcaucaagcuuaccaugagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5452 - RNA, 2449 nt, Artificial Sequence
  KU761561.1 prME-short mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5453 - RNA, 2449 nt, Artificial Sequence
  KX806557.2 prME-short mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaacuggauguucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaaggucccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5454 - RNA, 2449 nt, Artificial Sequence
  LC191864.1 prME-short mRNA Design 2 wild type
ggggcgcugccuacggagguggcagccaucuccuucucggcaucaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacaugacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugaccugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguccacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggagugguagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaacggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5455 - RNA, 2449 nt, Artificial Sequence
  KU744693.1 prME-short mRNA Design 2 wild type
ggggcgcugccuacggagguggcagccaucuccuucucggcaucaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcucccuucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuauuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucagguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5456 - RNA, 2440 nt, Artificial Sequence
  KU963574.2 prME-short mRNA Design 2 wild type
ggggcgcugccuacggagguggcagccaucuccuucucggcaucaagcuuaccaugggagcugaugccagcaucggaaucgucagccuccugcugacuacagucauggcagcagagaucacuagacgcgggagugcauacuacauguacuuggacaggagcgaugcugguaaggccauuucuuucguuaccacacugggggugaacaaaugccaugugcagaucauggaccucgggcauaugugugacgccaccaugaguuaugagugccccaugcuggacgagggaguggagccagaugacgucgauugcuggugcaacacgacaucaacuuggguuguguacggaaccugucaucauaaaaaaggugaagcacgacgauccagaagagccgugacgcuuccuucucacucuacaaggaaguugcaaacgcgaucgcagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaguuggggguguguuuaacucauugggcaaggguauucaccagaucuuuggagcagcuuucaaaucacuguucggaggaauguccugguucucacagauccucauaggcacacuguuggugugguugggucugaacacaaagaauggaucuaucucccucacaugcuuggccuugggaggagugaugaucuuccuuuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5457 - RNA, 2458 nt, Artificial Sequence
  KF383120.1 prME-short mRNA Design 2 wild type
ggggcgcugccuacggagguggcagccaucuccuucucggcaucaagcuuaccaugggcgcagacaccagcaucggaaucauuggccuccugcugacuacagccauggcagcagagaucacuagacgcgggagugcauacuacauguacuuggauaggagcgaugccgggaaggccauuucguuugcuaccacaaugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcccucaagaagagcugucacgcuuccuucccauuccacaagaaaguuacagacacggucacaaaccuggcuugaaucacgggaguacacgaagcaccugaucaaaguugagaacuggauacuccggaauccaggguucacaguugcugcucuagcaauggccuggcucuugggaaauuccacgagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuguuggaggcguguucaauucucugggcaagggaguucaucaggucuucggagcagccuuuaaauccuuauuuggcggaauguccugguuuucacaaauucuuauuggcacacuuuuagugugguugggcuugaauacaaaaaauggauccauuucccuugcaugucuggcgcuuggaggggcgaugaucuuucucuccacggccgucucggcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5458 - RNA, 1741 nt, Artificial Sequence; identical to SEQ ID NO: 291
  KU321639.1 solE mRNA Design 2 wild type

SEQ ID NO: 5459 - RNA, 1741 nt, Artificial Sequence; identical to SEQ ID NO: 295
  KU312312.1 solE mRNA Design 2 wild type

SEQ ID NO: 5460 - RNA, 1729 nt, Artificial Sequence; identical to SEQ ID NO: 299
  AY632535.2 solE mRNA Design 2 wild type

SEQ ID NO: 5461 - RNA, 1741 nt, Artificial Sequence; identical to SEQ ID NO: 5236
  KU527068.1 solE mRNA Design 2 wild type

SEQ ID NO: 5462 - RNA, 1741 nt, Artificial Sequence
  KX421193.1 solE mRNA Design 2 wild type
ggggcgcugccuacggagguggcagccaucuccuucucggcaucaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5463 - RNA, 1741 nt, Artificial Sequence
  LC002520.1 solE mRNA Design 2 wild type
ggggcgcugccuacggagguggcagccaucuccuucucggcaucaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5464 - RNA, 1723 nt, Artificial Sequence
  DQ859059.1 solE mRNA Design 2 wild type
ggggcgcugccuacggagguggcagccaucuccuucucggcaucaagcuuaccaugagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5465 - RNA, 1729 nt, Artificial Sequence
  KU963573.2 solE mRNA Design 2 wild type
ggggcgcugccuacggagguggcagccaucuccuucucggcaucaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5466 - RNA, 1741 nt, Artificial Sequence
  KY075939.1 solE mRNA Design 2 wild type
ggggcgcugccuacggagguggcagccaucuccuucucggcaucaagcuuaccaugagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5467 - RNA, 1741 nt, Artificial Sequence
  KX447516.1 solE mRNA Design 2 wild type
ggggcgcugccuacggagguggcagccaucuccuucucggcaucaagcuuaccaugagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5468 - RNA, 1741 nt, Artificial Sequence
  KX447515.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5469 - RNA, 1741 nt, Artificial Sequence
  KU758874.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5470 - RNA, 1741 nt, Artificial Sequence
  KU729218.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5471 - RNA, 1741 nt, Artificial Sequence
  KU501217.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5472 - RNA, 1741 nt, Artificial Sequence
  KU761561.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5473 - RNA, 1741 nt, Artificial Sequence
  KY075937.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5474 - RNA, 1741 nt, Artificial Sequence
  KY014317.1 solE mRNA Design 2 wild type
ggggcgcugccuacggagguggcagccaucuccuucucggcaucaagcuuaccaugagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5475 - RNA, 1741 nt, Artificial Sequence
  KU870645.1 solE mRNA Design 2 wild type
ggggcgcugccuacggagguggcagccaucuccuucucggcaucaagcuuaccaugagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5476 - RNA, 1741 nt, Artificial Sequence
  KU922923.1 solE mRNA Design 2 wild type
ggggcgcugccuacggagguggcagccaucuccuucucggcaucaagcuuaccaugagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5477 - RNA, 1741 nt, Artificial Sequence
  KU497555.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5478 - RNA, 1741 nt, Artificial Sequence
  KU312314.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5479 - RNA, 1741 nt, Artificial Sequence
  KY014314.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5480 - RNA, 1741 nt, Artificial Sequence
  KX447517.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5481 - RNA, 1741 nt, Artificial Sequence
  KU729217.2 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5482 - RNA, 1741 nt, Artificial Sequence
  KY328290.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5483 - RNA, 1741 nt, Artificial Sequence
  KX087101.3 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5484 - RNA, 1741 nt, Artificial Sequence
  KY003156.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5485 - RNA, 1741 nt, Artificial Sequence
  KU758876.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5486 - RNA, 1741 nt, Artificial Sequence
  KU926310.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5487 - RNA, 1741 nt, Artificial Sequence
  KU681081.3 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5488 - RNA, 1741 nt, Artificial Sequence
  KU744693.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5489 - RNA, 1741 nt, Artificial Sequence
  EU545988.1 solE mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5490 - RNA, 1741 nt, Artificial Sequence
  KY007221.1 solE mRNA Design 2 wild type
ggggcgcugccuacggagguggcagccaucuccuucucggcaucaagcuuaccaugagccaaaaagucauauacuuggucaugauacugcugauugccccggcauauagcaucaggugcauaggagucaacaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5491 - RNA, 1741 nt, Artificial Sequence
  KY003152.1 solE mRNA Design 2 wild type
ggggcgcugccuacggagguggcagccaucuccuucucggcaucaagcuuaccaugagccaaaaagucauauauuuggucaugauacugcugauugccccggcauacagcaucaggugcauaggagucagcaauagggacuuuguggaagguaugucaggugggacuuggguugauguugucuuggaacauggaggcuguguuaccguaauggcacaggacaaaccgacugucgacauagagcugguuacaacaacaguuagcaacauggcggagguaagauccuacugcuaugaggcaucaauaucggauauggcuucggacagccgcugcccaacacaaggugaggccuaccuugacaagcagucagacacucaauaugucugcaaaagaacguuaguggauagaggcuggggaaauggauguggacuuuuuggaaaagggagccuggugacaugcgcuaaguuugcaugcuccaagaaaaugaccgggaagagcauccagccagagaaccuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggugugucauacuccuugugugcugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5492 - RNA, 1741 nt, Artificial Sequence
  KX694533.2 solE mRNA Design 2 wild type
ggggcgcugccuacggagguggcagccaucuccuucucggcaucaagcuuaccaugagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5493 - RNA, 1741 nt, Artificial Sequence
  KX601167.1 solE mRNA Design 2 wild type
ggggcgcugccuacggagguggcagccaucuccuucucggcaucaagcuuaccaugagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5494 - RNA, 1741 nt, Artificial Sequence
  KY288905.1 solE mRNA Design 2 wild type
ggggcgcugccuacggagguggcagccaucuccuucucggcaucaagcuuaccaugagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5495 - RNA, 1741 nt, Artificial Sequence
  KF268950.1 solE mRNA Design 2 wild type
ggggcgcugccuacggagguggcagccaucuccuucucggcaucaagcuuaccaugagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5496 - RNA, 1741 nt, Artificial Sequence
  KF383116.1 solE mRNA Design 2 wild type
ggggcgcugccuacggagguggcagccaucuccuucucggcaucaagcuuaccaugagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5497 - RNA, 1723 nt, Artificial Sequence
  KU963574.2 solE mRNA Design 2 wild type
ggggcgcugccuacggagguggcagccaucuccuucucggcaucaagcuuaccaugagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5498 - RNA, 1741 nt, Artificial Sequence
  KF383118.1 solE mRNA Design 2 wild type
ggggcgcugccuacggagguggcagccaucuccuucucggcaucaagcuuaccaugagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5499 - RNA, 1741 nt, Artificial Sequence
  KX520666.1 solE mRNA Design 2 wild type
ggggcgcugccuacggagguggcagccaucuccuucucggcaucaagcuuaccaugcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5500 - RNA, 1741 nt, Artificial Sequence
  KF383120.1 solE mRNA Design 2 wild type
ggggcgcugccuacggagguggcagccaucuccuucucggcaucaagcuuaccaugagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5501 - RNA, 2524 nt, Artificial Sequence; identical to SEQ ID NO: 302
  R5050/R5051 ZIKV (strain ZikaSPH2015) Polyprotein(93-804) mRNA Design 2 GC

SEQ ID NO: 5502 - RNA, 2524 nt, Artificial Sequence; identical to SEQ ID NO: 307
  ZIKV (isolate Z1106033) Polyprotein(93-804) mRNA Design 2 GC

SEQ ID NO: 5503 - RNA, 2512 nt, Artificial Sequence; identical to SEQ ID NO: 312
  ZIKV (strain MR 766) Polyprotein(93-800) mRNA Design 2 GC

SEQ ID NO: 5504 - RNA, 2524 nt, Artificial Sequence
  ZIKV (strain NatalRGN) Polyprotein(93-804) mRNA Design 2 GC
ggggcgcugccuacggagguggcagccaucuccuucucggcaucaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5505 - RNA, 2449 nt, Artificial Sequence
  R5052/R5053 ZIKV (strain ZikaSPH2015) Polyprotein(108-794) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5506 - RNA, 2449 nt, Artificial Sequence
  ZIKV (isolate Z1106033) Polyprotein(108-794) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5507 - RNA, 2437 nt, Artificial Sequence
  ZIKV (strain MR 766) Polyprotein(108-790) mRNA Design 2 GC
ggggcgcugccuacggagguggcagccaucuccuucucggcaucaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5508 - RNA, 2449 nt, Artificial Sequence
  ZIKV (strain NatalRGN) Polyprotein(108-794) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5509 - RNA, 1741 nt, Artificial Sequence; identical to SEQ ID NO: 304
  R5054/R5055 ZIKV (strain ZikaSPH2015) Polyprotein(273-723) mRNA Design 2 GC

SEQ ID NO: 5510 - RNA, 1741 nt, Artificial Sequence; identical to SEQ ID NO: 309
  ZIKV (isolate Z1106033) Polyprotein(273-723) mRNA Design 2 GC

SEQ ID NO: 5511 - RNA, 1729 nt, Artificial Sequence; identical to SEQ ID NO: 314
  ZIKV (strain MR 766) Polyprotein(273-719) mRNA Design 2 GC

SEQ ID NO: 5512 - RNA, 1741 nt, Artificial Sequence
  ZIKV (strain NatalRGN) Polyprotein(273-723) mRNA Design 2 GC
ggggcgcugccuacggagguggcagccaucuccuucucggcaucaagcuuaccaugagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5513 - RNA, 2449 nt, Artificial Sequence
  R5180 ZIKV (strain ZikaSPH2015) Polyprotein(108-794)(F398S) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuccgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5514 - RNA, 2449 nt, Artificial Sequence
  ZIKV (isolate Z1106033) Polyprotein(108-794)(F398S) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuccgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5515 - RNA, 2437 nt, Artificial Sequence
  ZIKV (strain MR 766) Polyprotein(108-790)(F398S) mRNA Design 2 GC
ggggcgcugccuacggagguggcagccaucuccuucucggcaucaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguccggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5516 - RNA, 2449 nt, Artificial Sequence
  ZIKV (strain NatalRGN) Polyprotein(108-794)(F398S) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuccgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5517 - RNA, 2449 nt, Artificial Sequence
  R5181 ZIKV (strain ZikaSPH2015) Polyprotein(108-794)(N444Q) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucguccaggacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5518 - RNA, 2449 nt, Artificial Sequence
  ZIKV (isolate Z1106033) Polyprotein(108-794)(N444Q) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugcaggacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5519 - RNA, 2449 nt, Artificial Sequence
  ZIKV (strain NatalRGN) Polyprotein(108-794)(N444Q) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugcaggacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5520 - RNA, 2449 nt, Artificial Sequence
  R5182 ZIKV (strain ZikaSPH2015) Polyprotein(108-694)-Cterm-JAEV1-E(400-500) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5521 - RNA, 2449 nt, Artificial Sequence
  ZIKV (isolate Z1106033) Polyprotein(108-694)-Cterm-JAEV1-E(400-500) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5522 - RNA, 2437 nt, Artificial Sequence
  ZIKV (strain MR 766) Polyprotein(108-690)-Cterm-JAEV1-E(400-500) mRNA Design 2 GC
ggggcgcugccuacggagguggcagccaucuccuucucggcaucaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5523 - RNA, 2449 nt, Artificial Sequence
  ZIKV (strain NatalRGN) Polyprotein(108-694)-Cterm-JAEV1-E(400-500) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5524 - RNA, 2524 nt, Artificial Sequence
  R5618 ZIKV (strain ZikaSPH2015) Polyprotein(93-804) mRNA Design 2 GC
ggggcgcugccuacggagguggcagccaucuccuucucggcaucaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5525 - RNA, 2521 nt, Artificial Sequence
  ZIKV prME variant mRNA Design 2 GC
ggggcgcugccuacggagguggcagccaucuccuucucggcaucaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5526 - RNA, 2518 nt, Artificial Sequence
  ZIKV prME variant mRNA Design 2 GC
ggggcgcugccuacggagguggcagccaucuccuucucggcaucaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5527 - RNA, 2515 nt, Artificial Sequence
  ZIKV prME variant mRNA Design 2 GC
ggggcgcugccuacggagguggcagccaucuccuucucggcaucaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5528 - RNA, 2512 nt, Artificial Sequence
  ZIKV prME variant mRNA Design 2 GC
ggggcgcugccuacggagguggcagccaucuccuucucggcaucaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5529 - RNA, 2509 nt, Artificial Sequence
  ZIKV prME variant mRNA Design 2 GC
ggggcgcugccuacggagguggcagccaucuccuucucggcaucaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5530 - RNA, 2506 nt, Artificial Sequence
  ZIKV prME variant mRNA Design 2 GC
ggggcgcugccuacggagguggcagccaucuccuucucggcaucaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5531 - RNA, 2503 nt, Artificial Sequence
  ZIKV prME variant mRNA Design 2 GC
ggggcgcugccuacggagguggcagccaucuccuucucggcaucaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5532 - RNA, 2500 nt, Artificial Sequence
  ZIKV prME variant mRNA Design 2 GC
ggggcgcugccuacggagguggcagccaucuccuucucggcaucaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5533 - RNA, 2497 nt, Artificial Sequence
  ZIKV prME variant mRNA Design 2 GC
ggggcgcugccuacggagguggcagccaucuccuucucggcaucaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5534 - RNA, 2494 nt, Artificial Sequence
  ZIKV prME variant mRNA Design 2 GC
ggggcgcugccuacggagguggcagccaucuccuucucggcaucaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5535 - RNA, 2491 nt, Artificial Sequence
  ZIKV prME variant mRNA Design 2 GC
ggggcgcugccuacggagguggcagccaucuccuucucggcaucaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5536 - RNA, 2488 nt, Artificial Sequence
  ZIKV prME variant mRNA Design 2 GC
ggggcgcugccuacggagguggcagccaucuccuucucggcaucaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5537 - RNA, 2485 nt, Artificial Sequence
  ZIKV prME variant mRNA Design 2 GC
ggggcgcugccuacggagguggcagccaucuccuucucggcaucaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5538 - RNA, 2482 nt, Artificial Sequence
  ZIKV prME variant mRNA Design 2 GC
ggggcgcugccuacggagguggcagccaucuccuucucggcaucaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5539 - RNA, 2479 nt, Artificial Sequence
  ZIKV prME variant mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5540 - RNA, 2479 nt, Artificial Sequence
  ZIKV prME variant mRNA Design 2 GC
ggggcgcugccuacggagguggcagccaucuccuucucggcaucaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5541 - RNA, 2491 nt, Artificial Sequence
  ZIKV prME variant mRNA Design 2 GC
ggggcgcugccuacggagguggcagccaucuccuucucggcaucaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5542 - RNA, 2515 nt, Artificial Sequence
  ZIKV prME variant mRNA Design 2 GC
ggggcgcugccuacggagguggcagccaucuccuucucggcaucaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5543 - RNA, 2515 nt, Artificial Sequence
  ZIKV prME variant mRNA Design 2 GC
ggggcgcugccuacggagguggcagccaucuccuucucggcaucaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5544 - RNA, 2506 nt, Artificial Sequence
  ZIKV prME variant mRNA Design 2 GC
ggggcgcugccuacggagguggcagccaucuccuucucggcaucaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5545 - RNA, 2503 nt, Artificial Sequence
  ZIKV prME variant mRNA Design 2 GC
ggggcgcugccuacggagguggcagccaucuccuucucggcaucaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5546 - RNA, 2500 nt, Artificial Sequence
  ZIKV prME variant mRNA Design 2 GC
ggggcgcugccuacggagguggcagccaucuccuucucggcaucaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5547 - RNA, 2497 nt, Artificial Sequence
  ZIKV prME variant mRNA Design 2 GC
ggggcgcugccuacggagguggcagccaucuccuucucggcaucaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5548 - RNA, 2494 nt, Artificial Sequence
  ZIKV prME variant mRNA Design 2 GC
ggggcgcugccuacggagguggcagccaucuccuucucggcaucaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5549 - RNA, 2491 nt, Artificial Sequence
  ZIKV prME variant mRNA Design 2 GC
ggggcgcugccuacggagguggcagccaucuccuucucggcaucaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5550 - RNA, 2488 nt, Artificial Sequence
  ZIKV prME variant mRNA Design 2 GC
ggggcgcugccuacggagguggcagccaucuccuucucggcaucaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5551 - RNA, 2485 nt, Artificial Sequence
  ZIKV prME variant mRNA Design 2 GC
ggggcgcugccuacggagguggcagccaucuccuucucggcaucaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5552 - RNA, 2482 nt, Artificial Sequence
  ZIKV prME variant mRNA Design 2 GC
ggggcgcugccuacggagguggcagccaucuccuucucggcaucaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5553 - RNA, 2479 nt, Artificial Sequence
  ZIKV prME variant mRNA Design 2 GC
ggggcgcugccuacggagguggcagccaucuccuucucggcaucaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5554 - RNA, 2476 nt, Artificial Sequence
  ZIKV prME variant mRNA Design 2 GC
ggggcgcugccuacggagguggcagccaucuccuucucggcaucaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5555 - RNA, 2473 nt, Artificial Sequence
  ZIKV prME variant mRNA Design 2 GC
ggggcgcugccuacggagguggcagccaucuccuucucggcaucaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5556 - RNA, 2470 nt, Artificial Sequence
  ZIKV prME variant mRNA Design 2 GC
ggggcgcugccuacggagguggcagccaucuccuucucggcaucaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5557 - RNA, 2467 nt, Artificial Sequence
  ZIKV prME variant mRNA Design 2 GC
ggggcgcugccuacggagguggcagccaucuccuucucggcaucaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5558 - RNA, 2464 nt, Artificial Sequence
  ZIKV prME variant mRNA Design 2 GC
ggggcgcugccuacggagguggcagccaucuccuucucggcaucaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5559 - RNA, 2461 nt, Artificial Sequence
  ZIKV prME variant mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5560 - RNA, 2461 nt, Artificial Sequence
  ZIKV prME variant mRNA Design 2 GC
ggggcgcugccuacggagguggcagccaucuccuucucggcaucaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5561 - RNA, 2473 nt, Artificial Sequence
  ZIKV prME variant mRNA Design 2 GC
ggggcgcugccuacggagguggcagccaucuccuucucggcaucaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5562 - RNA, 2497 nt, Artificial Sequence
  ZIKV prME variant mRNA Design 2 GC
ggggcgcugccuacggagguggcagccaucuccuucucggcaucaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5563 - RNA, 2497 nt, Artificial Sequence
  ZIKV prME variant mRNA Design 2 GC
ggggcgcugccuacggagguggcagccaucuccuucucggcaucaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5564 - RNA, 2497 nt, Artificial Sequence
  ZIKV prME variant mRNA Design 2 GC
ggggcgcugccuacggagguggcagccaucuccuucucggcaucaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5565 - RNA, 2494 nt, Artificial Sequence
  ZIKV prME variant mRNA Design 2 GC
ggggcgcugccuacggagguggcagccaucuccuucucggcaucaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5566 - RNA, 2491 nt, Artificial Sequence
  ZIKV prME variant mRNA Design 2 GC
ggggcgcugccuacggagguggcagccaucuccuucucggcaucaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5567 - RNA, 2488 nt, Artificial Sequence
  ZIKV prME variant mRNA Design 2 GC
ggggcgcugccuacggagguggcagccaucuccuucucggcaucaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5568 - RNA, 2485 nt, Artificial Sequence
  ZIKV prME variant mRNA Design 2 GC
ggggcgcugccuacggagguggcagccaucuccuucucggcaucaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5569 - RNA, 2482 nt, Artificial Sequence
  ZIKV prME variant mRNA Design 2 GC
ggggcgcugccuacggagguggcagccaucuccuucucggcaucaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5570 - RNA, 2479 nt, Artificial Sequence
  ZIKV prME variant mRNA Design 2 GC
ggggcgcugccuacggagguggcagccaucuccuucucggcaucaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5571 - RNA, 2476 nt, Artificial Sequence
  ZIKV prME variant mRNA Design 2 GC
ggggcgcugccuacggagguggcagccaucuccuucucggcaucaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5572 - RNA, 2473 nt, Artificial Sequence
  ZIKV prME variant mRNA Design 2 GC
ggggcgcugccuacggagguggcagccaucuccuucucggcaucaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5573 - RNA, 2470 nt, Artificial Sequence
  ZIKV prME variant mRNA Design 2 GC
ggggcgcugccuacggagguggcagccaucuccuucucggcaucaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5574 - RNA, 2467 nt, Artificial Sequence
  ZIKV prME variant mRNA Design 2 GC
ggggcgcugccuacggagguggcagccaucuccuucucggcaucaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5575 - RNA, 2464 nt, Artificial Sequence
  ZIKV prME variant mRNA Design 2 GC
ggggcgcugccuacggagguggcagccaucuccuucucggcaucaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5576 - RNA, 2461 nt, Artificial Sequence
  ZIKV prME variant mRNA Design 2 GC
ggggcgcugccuacggagguggcagccaucuccuucucggcaucaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5577 - RNA, 2458 nt, Artificial Sequence
  ZIKV prME variant mRNA Design 2 GC
ggggcgcugccuacggagguggcagccaucuccuucucggcaucaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5578 - RNA, 2455 nt, Artificial Sequence
  ZIKV prME variant mRNA Design 2 GC
ggggcgcugccuacggagguggcagccaucuccuucucggcaucaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5579 - RNA, 2452 nt, Artificial Sequence
  ZIKV prME variant mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5580 - RNA, 2452 nt, Artificial Sequence
  ZIKV prME variant mRNA Design 2 GC
ggggcgcugccuacggagguggcagccaucuccuucucggcaucaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5581 - RNA, 2464 nt, Artificial Sequence
  ZIKV prME variant mRNA Design 2 GC
ggggcgcugccuacggagguggcagccaucuccuucucggcaucaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5582 - RNA, 2488 nt, Artificial Sequence
  ZIKV prME variant mRNA Design 2 GC
ggggcgcugccuacggagguggcagccaucuccuucucggcaucaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5583 - RNA, 2488 nt, Artificial Sequence
  ZIKV prME variant mRNA Design 2 GC
ggggcgcugccuacggagguggcagccaucuccuucucggcaucaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5584 - RNA, 2494 nt, Artificial Sequence
  ZIKV prME variant mRNA Design 2 GC
ggggcgcugccuacggagguggcagccaucuccuucucggcaucaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5585 - RNA, 2488 nt, Artificial Sequence
  ZIKV prME variant mRNA Design 2 GC
ggggcgcugccuacggagguggcagccaucuccuucucggcaucaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5586 - RNA, 2491 nt, Artificial Sequence
  ZIKV prME variant mRNA Design 2 GC
ggggcgcugccuacggagguggcagccaucuccuucucggcaucaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5587 - RNA, 2485 nt, Artificial Sequence
  ZIKV prME variant mRNA Design 2 GC
ggggcgcugccuacggagguggcagccaucuccuucucggcaucaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5588 - RNA, 2482 nt, Artificial Sequence
  ZIKV prME variant mRNA Design 2 GC
ggggcgcugccuacggagguggcagccaucuccuucucggcaucaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5589 - RNA, 2479 nt, Artificial Sequence
  ZIKV prME variant mRNA Design 2 GC
ggggcgcugccuacggagguggcagccaucuccuucucggcaucaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5590 - RNA, 2476 nt, Artificial Sequence
  ZIKV prME variant mRNA Design 2 GC
ggggcgcugccuacggagguggcagccaucuccuucucggcaucaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5591 - RNA, 2473 nt, Artificial Sequence
  ZIKV prME variant mRNA Design 2 GC
ggggcgcugccuacggagguggcagccaucuccuucucggcaucaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5592 - RNA, 2470 nt, Artificial Sequence
  ZIKV prME variant mRNA Design 2 GC
ggggcgcugccuacggagguggcagccaucuccuucucggcaucaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5593 - RNA, 2467 nt, Artificial Sequence
  ZIKV prME variant mRNA Design 2 GC
ggggcgcugccuacggagguggcagccaucuccuucucggcaucaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5594 - RNA, 2464 nt, Artificial Sequence
  ZIKV prME variant mRNA Design 2 GC
ggggcgcugccuacggagguggcagccaucuccuucucggcaucaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5595 - RNA, 2461 nt, Artificial Sequence
  ZIKV prME variant mRNA Design 2 GC
ggggcgcugccuacggagguggcagccaucuccuucucggcaucaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5596 - RNA, 2458 nt, Artificial Sequence
  ZIKV prME variant mRNA Design 2 GC
ggggcgcugccuacggagguggcagccaucuccuucucggcaucaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5597 - RNA, 2455 nt, Artificial Sequence
  ZIKV prME variant mRNA Design 2 GC
ggggcgcugccuacggagguggcagccaucuccuucucggcaucaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5598 - RNA, 2452 nt, Artificial Sequence
  ZIKV prME variant mRNA Design 2 GC
ggggcgcugccuacggagguggcagccaucuccuucucggcaucaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5599 - RNA, 2449 nt, Artificial Sequence
  R5612 ZIKV (strain ZikaSPH2015) Polyprotein(108-794) mRNA Design 2 GC
ggggcgcugccuacggagguggcagccaucuccuucucggcaucaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5600 - RNA, 2449 nt, Artificial Sequence
  ZIKV prME variant mRNA Design 2 GC
ggggcgcugccuacggagguggcagccaucuccuucucggcaucaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5601 - RNA, 2461 nt, Artificial Sequence
  ZIKV prME variant mRNA Design 2 GC
ggggcgcugccuacggagguggcagccaucuccuucucggcaucaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5602 - RNA, 2485 nt, Artificial Sequence
  ZIKV prME variant mRNA Design 2 GC
ggggcgcugccuacggagguggcagccaucuccuucucggcaucaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5603 - RNA, 2485 nt, Artificial Sequence
  ZIKV prME variant mRNA Design 2 GC
ggggcgcugccuacggagguggcagccaucuccuucucggcaucaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5604 - RNA, 2524 nt, Artificial Sequence; identical to SEQ ID NO: 302
  KU321639.1 prME-long mRNA Design 2 GC

SEQ ID NO: 5605 - RNA, 2524 nt, Artificial Sequence; identical to SEQ ID NO: 307
  KU312312.1 prME-long mRNA Design 2 GC

SEQ ID NO: 5606 - RNA, 2512 nt, Artificial Sequence; identical to SEQ ID NO: 312
  AY632535.2 prME-long mRNA Design 2 GC

SEQ ID NO: 5607 - RNA, 2524 nt, Artificial Sequence; identical to SEQ ID NO: 5504
  KU527068.1 prME-long mRNA Design 2 GC

SEQ ID NO: 5608 - RNA, 2524 nt, Artificial Sequence
  KU720415.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaccggcuacgagaccgacgagaaccgcgccaagguggaggugacccccaacuccccgcgggccgaggcgacccucgggggcuucgggagccugggccuggacugcgagccccgcaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcggcagaccguggucgugcucgggagccaggagggcgccgugcacacggcccuggccggggcgcuggaggccgagauggacggcgccaagggcaagcuguucuccgggcaccucaagugccgccugaagauggacaagcuccggcugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcgccugaucaccgccaaccccgugaucaccgagagcaccgagaacuccaagaugaugcucgagcuggacccgcccuucggcgacagcuacaucgucaucggggugggcgacaagaagaucacgcaccacuggcaccgguccgggagcaccaucggcaaggccuucgaggcgaccgugcgcggcgccaagcggauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5609 - RNA, 2506 nt, Artificial Sequence
  DQ859059.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucacccugguggccgucgccaucgccuggcugcucggcuccagcaccucccagaaggugaucuaccuggugaugauccugcucaucgcccccgcguacagcauccgcugcaucggggucuccaaccgggacuucguggagggcaugagcggcgggacguggguggacgucgugcuggagcacggcgggugcgugaccgucauggcccaggacaagccgaccguggacaucgagcuggugaccacgaccgucuccaacauggccgaggugcgcagcuacugcuacgaggccuccaucagcgacauggccagcgacucccggugccccacccagggcgaggcguaccucgacaagcagagcgacacccaguacgugugcaagcgcacgcuggucgaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacgagaaccgcgccaagguggaggucacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgcgggcgccgacacggggaccccgcacuggaacaacaaggaggcccugguggaguucaaggacgcccacgccaagcggcagaccgucguggugcucggcagccaggagggggcgguccacaccgcccuggccggcgcccuggaggcggagauggacggggccaagggccgccucuucuccggccaccugaagugccggcugaagauggacaagcuccgccugaagggggugagcuacucccugugcacggccgccuucaccuucaccaaggugcccgccgagacccuccacggcaccgucacgguggaggugcaguacgcggggaccgacggccccugcaagguccccgcccagauggccguggacaugcagacccugaccccggugggccggcugaucacggccaaccccgucaucaccgagagcaccgagaacuccaagaugaugcucgagcuggacccgcccuucggggacagcuacaucgugaucggcgugggggacaagaagaucacccaccacuggcaccgcuccggcagcacgaucgggaaggccuucgaggcgaccguccggggcgccaagcgcauggccgugcugggcgacaccgccugggacuucgggagcgugggcggggucuucaacucccucggcaaggggauccaccagaucuucggcgccgcguucaagagccuguucggcgggauguccugguucagccagauccugaucggcacccugcucguguggcuggggcugaacacgaagaacggcuccaucagccugaccugccuggcccucgggggcgugaugaucuuccucuccaccgccgucagcgccgacgugggcugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5610 - RNA, 2524 nt, Artificial Sequence
  KX377335.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccgcaagaagggcgaggcccggcgcagccggcgcgcggugacccuccccucccacagcacccggaagcugcagacccgcucccagacguggcuggagagccgggaguacaccaagcaccucaucaaggucgagaacuggaucuuccgcaaccccggguucgcccugguggccguggccaucgccuggcugcucggcuccagcaccucccagaaggucaucuaccuggugaugauccugcucaucgcgcccgccuacagcauccggugcaucgggguguccaaccgcgacuucgucgagggcaugagcggcgggaccuggguggacgugguccuggagcacggcgggugcgugacggugauggcccaggacaagccgaccgucgacaucgagcuggugaccaccacgguguccaacauggccgagguccggagcuacugcuacgaggccuccaucagcgacauggcgagcgacucccgcugccccacccagggcgaggccuaccucgacaagcagagcgacacccaguacgugugcaagcggacccugguggaccgcggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaccggcuacgagaccgacgagaaccgggccaagguggaggugacccccaacuccccgcgcgccgaggcgacccucgggggcuucgggagccugggccuggacugcgagccccggaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcgccagaccguggucgugcucgggagccaggagggcgccgugcacacggcccuggccggggcgcuggaggccgagauggacggcgccaagggcaagcuguucuccgggcaccucaagugccggcugaagauggacaagcuccgccugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcggcugaucaccgccaaccccgugaucaccgagagcaccgagaacuccaagaugaugcucgagcuggacccgcccuucggcgacagcuacaucgucaucggggugggcgacaagaagaucacgcaccacuggcaccgcuccgggagcaccaucggcaaggccuucgaggcgaccgugcggggcgccaagcgcauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5611 - RNA, 2524 nt, Artificial Sequence
  LC002520.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaccgucaacgacaucggcuacgagaccgacgagaaccgcgccaagguggaggugacccccaacuccccgcgggccgaggcgacccucgggggcuucgggagccugggccuggacugcgagccccgcaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcggcagaccguggucgugcucgggagccaggagggcgccgugcacacggcccuggccggggcgcuggaggccgagauggacggcgccaagggcaagcuguucuccgggcaccucaagugccgccugaagauggacaagcuccggcugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcgccugaucaccgccaaccccgugaucaccgagagcaccgagaacuccaagaugaugcucgagcuggacccgcccuucggcgacagcuacaucgucaucggggugggcgacaagaagaucacgcaccacuggcaccgguccgggagcaccaucggcaaggccuucgaggcgaccgugcgcggcgccaagcggauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5612 - RNA, 2512 nt, Artificial Sequence
  KU963573.2 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucggcuacgagaccgacgagaaccgcgccaaggucgaggugacccccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccuggucgaguucaaggacgcccacgcgaagcggcagaccguggugguccucgggagccaggagggcgccgugcacaccgcccuggccggggcgcuggaggccgagauggacggcgccaagggcaagcuguucuccgggcaccucaagugccgccugaagauggacaagcuccggcugaagggcgugagcuacucccugugcacggccgccuucaccuucaccaagguccccgcggagacccuccacgggaccgugacgguggagguccaguacgccggcaccgacggccccugcaagauccccgugcagauggccguggacaugcagacccugaccccggucgggcgccugaucacggccaaccccgugaucaccgagagcaccgagaacuccaagaugaugcucgagcuggacccgcccuucggcgacagcuacaucgugaucggggucggcgacaagaagaucacccaccacuggcaccgguccgggagcacgaucggcaaggccuucgaggcgaccgugcgcggcgccaagcggauggccgugcugggggacaccgccugggacuucggcagcgucgggggcguguucaacucccucgggaagggcauccaccagaucuucggcgccgcguucaagagccuguucgggggcauguccugguucagccagauccugaucgggacccugcucguguggcugggccugaacacgaagaacggguccaucagccugaccugccucgcccugggcggcgucaugaucuuccucuccaccgccgugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5613 - RNA, 2524 nt, Artificial Sequence
  KX694534.2 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggcggggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5614 - RNA, 2524 nt, Artificial Sequence
  KX447520.1 prME-long mRNA Design 2 GC
ggggcgcugccuacggagguggcagccaucuccuucucggcaucaagcuuaccaugcgcaucaucaacgcccggaaggagaagaagcgccggggcgccgacgcgagcguggggaucgucggccugcuccugaccaccgccauggccgccgaggugacgcgccggggguccgccuacuacauguaccuggaccgcaacgacgcgggcgaggccaucagcuuccccaccacccucgggaugaacaagugcuacauccagaucauggaccugggccacaugugcgacgccaccauguccuacgagugcccgaugcuggacgagggcguggagcccgacgacgucgacugcuggugcaacacgaccagcaccugggugguguacgggaccugccaccacaagaagggcgaggcccggcgcucccggcgcgcggucacgcuccccagccacuccacccggaagcugcagacccgcagccagaccuggcuggagucccgggaguacacgaagcaccucauccgcguggagaacuggaucuuccggaaccccggguucgcccuggccgccgccgcgaucgccuggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucaccgugauggcccaggacaagcccacgguggacaucgagcuggucaccaccaccgugagcaacauggcggaggugcgcuccuacugcuacgaggccagcaucuccgacauggccagcgacagccggugccccacgcagggcgaggccuaccucgacaagcaguccgacacccaguacgucugcaagcgcacccugguggaccggggcugggggaacggcugcgggcuguucggcaaggggagccucgugaccugcgccaaguucgcgugcuccaagaagaugacgggcaagagcauccagcccgagaaccuggaguaccgcaucaugcuguccguccacggcagccagcacuccgggaugaucgugaacgacaccggccacgagaccgacgagaaccgcgccaaggucgagaucaccccgaacagcccccgggccgaggccacgcucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5615 - RNA, 2524 nt, Artificial Sequence
  KX369547.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccgggcuggcgcuggccgccgccgccaucgcguggcuccugggcagcuccaccagccagaaggugaucuaccuggucaugauccuccugaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5616 - RNA, 2524 nt, Artificial Sequence
  KX447515.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacugguaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5617 - RNA, 2524 nt, Artificial Sequence
  KU501217.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgagauccgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5618 - RNA, 2524 nt, Artificial Sequence
  KU312314.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugccccaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugcuggcccagauggcggucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5619 - RNA, 2524 nt, Artificial Sequence
  KX446950.2 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgacccuggacgagggcguggagcccgacgacgucgacugcuggugcaacaccaccagcacgugggugguguacgggaccugccaccacaagaagggcgaggcccggcgcucccggcgcgccgucacccuccccagccacuccacccggaagcugcagacgcgcagccagaccuggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggcgagcaucuccgacauggccagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucgccugcuccaagaagaugaccggcaagagcauccagcccgagaaccuggaguaccgcaucaugcuguccguccacggcagccagcacuccgggaugaucgugaacgacaccggccacgagacggacgagaaccgcgcgaaggucgagaucaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgagagcaccgagaacuccaagaugaugcucgagcuggacccgcccuucggcgacagcuacaucgucaucggggugggcgagaagaagaucacgcaccacuggcaccgcuccgggagcaccaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacgcuccugauguggcugggccucaacaccaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5620 - RNA, 2524 nt, Artificial Sequence
  KY003157.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccguggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5621 - RNA, 2524 nt, Artificial Sequence
  KX811222.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcgccugggugguguacgggaccugccaccacaagaagggcgaggcccggcgcucccggcgcgcggucacgcuccccagccacuccacccggaagcugcagacccgcccccagaccuggcuggagagccgggaguacacgaagcaccucauccgcguggagaacuggaucuuccggaacccgggguucgcccuggccgccgccgcgaucgccuggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagcccacgguggacaucgagcuggucaccaccaccguguccaacauggcggaggugcgcagcuacugcuacgaggccuccaucagcgacauggccuccgacagccggugccccacgcagggcgaggccuaccucgacaagcagagcgacacccaguacgucugcaagcgcacccugguggaccggggcugggggaacggcugcgggcuguucggcaaggggucccucgugaccugcgccaaguucgcgugcagcaagaagaugacgggcaaguccauccagccggagaaccuggaguaccgcaucaugcugagcguccacggcucccagcacagcgggaugaucgugaacgacaccggccacgagaccgacgagaaccgcgccaaggucgagaucacccccaacagcccccgggccgaggccacgcucgggggcuucgggucccugggccuggacugcgagccccgcaccggccucgacuucuccgaccuguacuaccugaccaugaacaacaagcacuggcucgugcacaaggagugguuccacgacaucccgcugcccuggcacgccggggcggacaccggcacgccccacuggaacaacaaggaggcccugguggaguucaaggacgcccacgccaagcggcagaccgucguggugcucgggagccaggagggcgcgguccacaccgcccuggccggggcccuggaggccgagauggacggcgcgaagggccgccucuccagcgggcaccugaagugccggcugaagauggacaagcuccgccugaagggcguguccuacagccugugcaccgccgccuucacguucaccaagauccccgccgagacccuccacgggaccgugaccgucgaggugcaguacgccggcacggacggcccgugcaaggugcccgcgcagauggccgucgacaugcagacccugacccccguggggcggcugaucaccgccaaccccgugaucacggaguccaccgagaacagcaagaugaugcucgagcuggacccgcccuucggcgacuccuacaucgucaucggggugggcgagaagaagaucacccaccacuggcaccgcagcggguccaccaucggcaaggccuucgaggccacggugcggggcgcgaagcgcauggccguccugggggacaccgccugggacuucggcagcgucgggggcgcccucaacagccuggggaagggcauccaccagaucuucggcgcggccuucaagucccuguucgggggcaugagcugguucucccagauccugaucgggacccuccugauguggcugggccucaacaccaagaacgggagcaucucccugaugugccuggcccucggcggcgugcugaucuuccugagcacggccguguccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5622 - RNA, 2524 nt, Artificial Sequence
  KX447516.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagcaagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5623 - RNA, 2524 nt, Artificial Sequence
  KX520666.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccacccgccagaaggugaucuaccuggucaugauccugcucaucgccccggccuacagcauccggugcaucgggguguccaaccgcgacuucguggagggcaugagcggcgggaccugggucgacguggugcuggagcacggcgggugcgucacggugauggcccaggacaagcccaccguggacaucgagcuggucaccaccacgguguccaacauggccgaggugcggagcuacugcuacgaggcguccaucagcgacauggccuccgacagccgcugccccacccagggcgaggccuaccucgacaagcagagcgacacccaguacgucugcaagcggacccugguggaccgcggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgggcgaaggucgagaucacgccgaacagcccccgcgccgaggccacccucgggggcuucgggucccugggccuggacugcgagccccggaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcgccagaccgucguggugcucgggagccaggagggcgccguccacaccgcgcuggccggggcccuggaggccgagauggacggcgccaagggccggcucuccagcgggcaccugaagugccgccugaagauggacaagcuccggcugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgaguccaccgagaacagcaagaugaugcucgagcuggacccgcccuucggcgacuccuacaucgucaucggggugggcgagaagaagaucacccaccacuggcaccggagcggguccacgaucggcaaggccuucgaggccaccgugcgcggcgccaagcggauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5624 - RNA, 2524 nt, Artificial Sequence
  KU729218.1 prME-long mRNA Design 2 GC
ggggcgcugccuacggagguggcagccaucuccuucucggcaucaagcuuaccaugcgcaucaucaacgcccggaaggagaagaagcgccggagcgccgacaccuccgugggcaucgucgggcugcuccugaccacggcgauggccgccgaggugacccgccggggcagcgccuacuacauguaccuggaccgcaacgacgccggggaggcgaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucauccgcguggagaacuggaucuuccggaaccccggcuucgcgcuggccgccgccgccaucgcguggcugcucggguccagcaccucccagaaggugaucuaccuggucaugauccugcucaucgccccggccuacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggcguccaucagcgacauggccagcgacucccggugccccacccagggggaggccuaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgcgcgaaggucgagaucacgccgaacagcccccgggccgaggccacccucggcggguucggcucccuggggcuggacugcgagccccgcaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcgcugguggaguucaaggacgcccacgccaagcggcagaccgucguggugcucggcagccaggagggggccguccacaccgcgcuggccggcgcccuggaggccgagauggacggggccaagggccgccucuccagcggccaccugaagugccggcugaagauggacaagcuccgccugaaggggguguccuacagccugugcaccgcggccuucaccuucaccaagauccccgccgagacccuccacggcaccgugacggucgaggugcaguacgccgggaccgacggccccugcaaggugccggcccagauggcggucgacacccagacccugacgcccgugggccggcugaucaccgccaaccccgugaucaccgaguccaccgagaacagcaagaugaugcucgagcuggacccgcccuucggggacuccuacaucgucaucggcgugggggagaagaagaucacgcaccacuggcaccgcagcggcagcaccaucgggaaggccuucgaggccaccgugcggggcgccaagcgcauggcgguccugggcgacaccgccugggacuucggguccgugggcggggcccucaacagccugggcaaggggauccaccagaucuucggcgccgcguucaagucccuguucggcgggaugagcugguucucccagauccugaucggcacgcuccugauguggcuggggcucaacaccaagaacggcagcaucucccugaugugccuggcccucgggggcgugcugaucuuccugagcaccgccgucuccgccgacgugggcugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5625 - RNA, 2524 nt, Artificial Sequence
  KU761561.1 prME-long mRNA Design 2 GC
ggggcgcugccuacggagguggcagccaucuccuucucggcaucaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccuccgacagccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcggguccacgaucggcaaggccuucgaggccaccgugcggggcgcccgccggauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5626 - RNA, 2524 nt, Artificial Sequence
  KY317938.1 prME-long mRNA Design 2 GC
ggggcgcugccuacggagguggcagccaucuccuucucggcaucaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5627 - RNA, 2524 nt, Artificial Sequence
  KY075939.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacucccugcgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5628 - RNA, 2524 nt, Artificial Sequence
  KX806557.2 prME-long mRNA Design 2 GC
ggggcgcugccuacggagguggcagccaucuccuucucggcaucaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggauguuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccuccgacagccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcggguccacgaucggcaaggccuucgaggccaccgugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5629 - RNA, 2524 nt, Artificial Sequence
  KU870645.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggauccugcggaaccccggguucgcgcuggccgccgccgccaucgcguggcuccugggcagcuccaccagccagaaggugaucuaccuggucaugauccuccugaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucgggaucggcgagaagaagaucacccaccacuggcaccgcuccgggagcacgaucggcaaggccuucgaggccaccgugcggggcgccaagcgcauggcggugcucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5630 - RNA, 2524 nt, Artificial Sequence
  KU729217.2 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucagcaccaccguguccaacauggccgaggugcgcagcuacugcuacgaggcgacgaucuccgacaucgccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgccgucgugcucgggucccaggagggcgcggugcacaccgcccuggccggggcccuggaggccgagauggacggcgcgaagggccgccucagcuccgggcaccugaagugccggcugaagauggacaagcuccgccugaagggcgucagcuacucccugugcaccgccgccuucaccuucaccaagauccccgccgagacccuccacgggaccgugacgguggagguccaguacgccggcaccgacggccccugcaaggugccggcgcagauggccguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgcgaagcgcauggccgugcugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5631 - RNA, 2524 nt, Artificial Sequence
  KU497555.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggacccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgaguccaccgagaacagcaagaugaugcucgagcuggacccgcccuucggcgacuccuacaucgucaucggggugggcgagaagaagaucacgcaccacuggcaccgcagcggguccaccaucggcaaggccuucgaggccaccgugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacgcuccugauguggcugggccucaacaccaagaacgggagcaucucccugaugugccuggcccucggcggcgugcugaucuuccugagcaccgccguguccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5632 - RNA, 2524 nt, Artificial Sequence
  KX087101.3 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgagcugcaguacgccggcaccgacggccccugcaaggugccggcccagauggcgguggacaugcagacccugacccccgucgggcggcucaucacggccaaccccgugaucaccgagagcaccgagaacuccaagaugaugcuggagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5633 - RNA, 2524 nt, Artificial Sequence
  KY075932.1 prME-long mRNA Design 2 GC
ggggcgcugccuacggagguggcagccaucuccuucucggcaucaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcaucgagaacuggaucuuccggaaccccggguucgcgcuggccgccgccgccaucgcguggcugcucggcagcuccaccagccagaaggugaucuaccuggugaugauccugcucaucgccccggccuacuccauccgcugcaucggggucagcaaccgggacuucguggagggcauguccggcgggaccuggguggacgucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5634 - RNA, 2524 nt, Artificial Sequence
  KY014317.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaucgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5635 - RNA, 2524 nt, Artificial Sequence
  KU758876.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgugaagggccgccucagcuccgggcaccugaagugccggcugaagauggacaagcuccgccugaagggcgugagcuacucccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgagagcaccgagaacuccaagaugaugcucgagcuggacccgcccuucggcgacagcuacaucgugaucggggugggcgagaagaagaucacccaccacuggcaccgcuccgggagcacgaucggcaaggccuucgaggccaccguccggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagcuucaugugccuggcgcugggcggcgugcucaucuuccuguccaccgccgugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5636 - RNA, 2524 nt, Artificial Sequence
  KU758874.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggcaagcucagcuccgggcaccugaagugccgccugaagauggacaagcuccggcugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgagagcaccgagaacuccaagaugaugcucgagcuggacccgcccuucggcgacagcuacaucgucaucggggugggcgagaagaagaucacccaccacuggcaccgguccgggagcacgaucggcaaggccuucgaggccaccgugcgcggcgccaagcggauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5637 - RNA, 2524 nt, Artificial Sequence
  KY014314.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggaggcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5638 - RNA, 2524 nt, Artificial Sequence
  KU926310.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcgccgacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5639 - RNA, 2524 nt, Artificial Sequence
  KU761560.1 prME-long mRNA Design 2 GC
ggggcgcugccuacggagguggcagccaucuccuucucggcaucaagcuuaccaugcgcaucaucaacgccggcaaggagaagaagcggcgcggggccgacaccaacgugggcaucgucgggcugcuccugaccacggcgauggccgccgaggugacccggcgcggcagcgccuacuacauguaccuggaccggaacgacgccggggaggcgaucuccuuccccaccacccucggcaugaacaagugcuacauccagaucauggaccugggccacaugugcgacgccacgaugagcuacgagugcccgaugcuggacgaggggguggagcccgacgacgucgacugcuggugcaacaccaccuccaccugggugguguacggcacgugccaccacaagaagggggaggcccgccggagccgccgggccgucacccuccccucccacagcacccgcaagcugcagacccggucccagacguggcuggagagccgcgaguacaccaagcaccucauccggguggagaacuggaucuuccgcaaccccggcuucgcgcuggccgccgccgccaucgcguggcugcucggguccagcaccucccagaaggugaucuaccuggucaugauccugcucaucgccccggccuacagcauccggugcaucggcguguccaaccgcgacuucguggagggcaugagcgggggcaccugggucgacguggugcuggagcacgggggcugcgucacggugauggcccaggacaagcccaccguggacaucgagcuggucaccaccacgguguccaacauggccgaggugcggagcuacugcuacgaggcguccaucagcgacauggccuccgacagccgcugccccacccagggcgaggccuaccucgacaagcagagcgacacccaguacgucugcaagcggacccugguggaccgcggguggggcaacgggugcggccuguucgggaagggcucccucgugacgugcgccaaguucgccugcagcaagaagaugaccggcaaguccauccagcccgagaaccuggaguaccggaucaugcugagcguccacgggucccagcacagcggcaugaucgugaacgacaccgggcacgagaccgacgagaaccgcgcgaaggucgagaucacgccgaacagcccccgcgccgaggccacccucggcggguucggcucccugggccuggacugcgagccccggaccgggcucgacuucuccgaccuguacuaccugaccaugaacaacaagcacuggcucgugcacaaggagugguuccacgacaucccccugccguggcacgccggcgccgacacggggacgccccacuggaacaacaaggaggcgcugguggaguucaaggacgcccacgccaagcgccagaccgucguggugcucggcagccaggagggggccguccacaccgcgcuggccggcgcccuggaggccgagauggacggcgccaaggggcggcucuccagcggccaccugaagugccgccugaagauggacaagcuccggcugaaggggguguccuacagccugugcaccgcggccuucaccuucaccaagauccccgccgagacccuccacggcaccgugacggucgaggugcaguacgccggcaccgacgggcccugcaaggugccggcccagauggcggucgacaugcagacccugacccccgugggccgccugaucacggccaaccccgugaucaccgaguccaccgagaacagcaagaugaugcucgagcuggacccgcccuucggggacuccuacaucgucaucggcgugggggagaagaagaucacccaccacuggcaccggagcggcuccacgaucggcaaggccuucgaggccaccgugcgcggggcccggcgcauggcgguccugggcgacaccgccugggacuucgggagcgugggcggggcccucaacagccugggcaagggcauccaccagaucuucggggccgcguucaagucccuguucggcgggaugagcugguucucccagauccugaucggcacccuccugauguggcuggggcucaacacgaagaacggcagcaucucccugaugugccuggcccucggcggggugcugaucuuccugagcaccgccgucuccgccgacgugggcugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5640 - RNA, 2524 nt, Artificial Sequence
  KY317939.1 prME-long mRNA Design 2 GC
ggggcgcugccuacggagguggcagccaucuccuucucggcaucaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaaggacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5641 - RNA, 2524 nt, Artificial Sequence
  KY075937.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggucagcgacagccggugccccacccagggcgaggccuaccucgacaagcaguccgacacccaguacgugugcaagcgcacccugguggaccggggcugggggaacggcugcgggcuguucggcaaggggagccucgucacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgccaagguggagaucacgccgaacagcccccgggcggaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcccuggucgaguucaaggacgcgcacgccaagcggcagaccguggugguccucgggucccaggagggcgccgugcacaccgcccuggcgggggcccuggaggccgagauggacggcgccaagggccgccucagcuccgggcaccugaagugccggcugaagauggacaagcuccgccugaagggcgugagcuacucccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgagagcaccgagaacuccaagaugaugcucgagcuggacccgcccuucggcgacagcuacaucgugaucggggugggcgagaagaagaucacccaccacuggcaccgcuccgggagcacgaucggcaaggccuucgaggccaccguccggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagccugaugugccuggcgcucggcggcgugcugaucuuccuguccaccgccgugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5642 - RNA, 2524 nt, Artificial Sequence
  LC191864.1 prME-long mRNA Design 2 GC
ggggcgcugccuacggagguggcagccaucuccuucucggcaucaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaugaccuccaccugggugguguacgggaccugccaccacaagaagggcgaggcccggcgcagccggcgcgccgucacgcuccccucccacagcacccggaagcugcagacccgcucccagaccuggcuggagagccgggaguacacgaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucaccgugauggcccaggacaagcccacgguggacaucgagcuggucaccaccaccguguccaacauggccgaggugcgcagcuacugcuacgaggcguccaucagcgacauggccuccgacagccggugccccacgcagggcgaggccuaccucgacaagcagagcgacacccaguacgucugcaagcgcacccugguggaccggggcugggggaacggcugcgggcuguucggcaaggggucccucgugaccugcgccaaguucgccugcagcaagaagaugacgggcaaguccauccagcccgagaaccuggaguaccgcaucaugcugagcguccacggcucccagcacagcgggaugaucgugaacgacaccggccacgagaccgacgagaaccgcgcgaaggucgagaucaccccgaacagcccccgggccgaggccacgcucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacaccggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucacguucaccaagauccccgccgagacccuccacgggaccgugaccgucgaggugcaguacgccggcacggacggccccugcaaggugccggcccagauggcggucgacaugcagacccugacccccguggggcggcugaucaccgccaaccccgugaucacggaguccaccgagaacagcaagaugaugcucgagcuggacccgcccuucggcgacuccuacaucgucaucggggugggcgagaagaagaucacccaccacuggcaccgcagcggguccaccaucggcaaggccuucgaggccacggugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacaccaagaacgggagcaucucccugaugugccuggcccucggcggcgugcugaucuuccugagcacggccguguccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5643 - RNA, 2524 nt, Artificial Sequence
  KX447517.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccgcccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagacccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5644 - RNA, 2524 nt, Artificial Sequence
  KU922923.1 prME-long mRNA Design 2 GC
ggggcgcugccuacggagguggcagccaucuccuucucggcaucaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugccccaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgcccuggccuacuccauccgcugcaucggggugagcaaccgggacuucguggagggcauguccggcgggaccugggucgacguggugcuggagcacggcgggugcgucacggugauggcccaggacaagccgaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgcccaacagcccgcgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugcccuggcacgccggggccgacacgggcaccccgcacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcacggcggccuucaccuucaccaagauccccgccgagacccugcacgggaccgugacggucgaggugcaguacgccggcaccgacggccccugcaaggugcccgcccagauggcggucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5645 - RNA, 2524 nt, Artificial Sequence
  KY003156.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucgggaucagcaaccgggacuucguggagggcauguccggcgggaccuggguggacgucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggauccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggagccaggagggcgccgugcacaccgcgcuggccggggcccuggaggccgagauggacggcgccaagggccgccucuccagcgggcaccugaagugccggcugaagauggacaagcuccgccugaagggcgucuccuacagccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgaguccaccgagaacagcaagaugaugcucgagcuggacccgcccuucggcgacuccuacaucgugaucggggucggcgagaagaagaucacccaccacuggcaccgcagcggguccacgaucggcaaggccuucgaggccaccgugcggggcgccaagcgcauggcggugcugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacgucgggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5646 - RNA, 2524 nt, Artificial Sequence
  KU312313.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacacgugcgacgccaccauguccuacgagugcccgaugcuggacgagggcguggagcccgacgacgucgacugcuggugcaacaccaccagcacgugggugguguacgggaccugccaccacaagaagggcgaggcccggcgcucccggcgcgccgucacccuccccagccacuccauccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacgccaagaacggguccaucagccugaugugccuggcccucggcggcgugcugaucuuccuguccacggccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5647 - RNA, 2524 nt, Artificial Sequence
  KY075935.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccagcggucccgccgggccgucacccuccccagccacuccacccgcaagcugcagacccggagccagacguggcuggagucccgcgaguacaccaagcaccucauccggguggagaacuggaucuuccgcaaccccggguucgcgcuggccgccgccgccaucgcguggcugcucggcagcuccaccagccagaaggugaucuaccuggucaugauccugcucaucgccccggccuacuccauccggugcaucggggugagcaaccgcgacuucguggagggcauguccggcgggaccugggucgacguggugcuggagcacggcgggugcgucacggugauggcccaggacaagcccaccguggacaucgagcuggucaccaccacggugagcaacauggccgaggugcgguccuacugcuacgaggcgagcaucuccgacauggccagcgacagccgcugccccacccagggcgaggccuaccucgacaagcaguccgacacccaguacgucugcaagcggacccugguggaccgcggcugggggaacggcugcgggcuguucggcaaggggagccucgugacgugcgccaaguucgccugcuccaagaagaugaccggcaagagcauccagcccgagaaccuggaguaccggaucaugcuguccguccacggcagccagcacuccgggaugaucgugaacgacaccggccacgagaccgacgagaaccgcgcgaaggucgagaucacgccgaacagcccccgcgccgaggccacccucgggggcuucgggucccugggccuggacugcgagccccggaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcgccagaccgucguggugcucgggucccaggagggcgccguccacaccgcgcuggccggggcccuggaggccgagauggacggcgccaagggccggcucagcuccgggcaccugaagugccgccugaagauggacaagcuccggcugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgagagcaccgagaacuccaagaugaugcucgagcuggacccgcccuucggcgacagcuacaucgucaucggggugggcgagaagaagaucacccaccacuggcaccgguccgggagcacgaucggcaaggccuucgaggccaccgugcgcggcgccaagcggauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5648 - RNA, 2524 nt, Artificial Sequence
  KY014320.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcaggcgcgcagccagaccuggcuggagucccgggaguacacgaagcaccucauccgcguggagaacuggaucuuccggaaccccggguucgcccuggccgccgccgcgaucgccuggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucaccgugauggcccaggacaagcccacgguggacaucgagcuggucaccaccaccgugagcaacauggcggaggugcgcuccuacugcuacgaggccagcaucuccgacauggccagcgacagccggugccccacgcagggcgaggccuaccucgacaagcaguccgacacccaguacgucugcaagcgcacccugguggaccggggcugggggaacggcugcgggcuguucggcaaggggagccucgugaccugcgccaaguucgcgugcuccaagaagaugacgggcaagagcauccagcccgagaaccuggaguaccgcaucaugcuguccguccacggcagccagcacuccgggaugaucgugaacgacaccggccacgagaccgacgagaaccgcgccaaggucgagaucaccccgaacagcccccgggccgaggccacgcucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5649 - RNA, 2524 nt, Artificial Sequence
  KX827309.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcagcgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccagcgacucccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcgggagcacgaucggcaaggccuucgaggccaccgugcggggcgccaagcgcauggcgguccugggggacaccgccugggacuucggcuccgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5650 - RNA, 2524 nt, Artificial Sequence
  KU681081.3 prME-long mRNA Design 2 GC
ggggcgcugccuacggagguggcagccaucuccuucucggcaucaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacaccggggccgacaccggcacgccccacuggaacaacaaggaggcccugguggaguucaaggacgcccacgcgaagcggcagaccgucguggugcucgggagccaggagggcgccguccacaccgcccuggccggggcgcuggaggccgagauggacggcgccaagggccgccucuccagcgggcaccugaagugccggcugaagauggacaagcuccgccugaagggcguguccuacagccugugcaccgccgccuucaccuucaccaagauccccgcggagacgcuccacgggaccgugaccgucgaggugcaguacgccggcaccgacggccccugcaaggugccggcccagauggccgucgacaugcagacgcugacccccguggggcggcugaucaccgccaaccccgugaucaccgagggcacggagaacuccaagaugaugcucgagcuggacccgcccuucggggacagcuacaucgucaucggcgugggggagaagaagaucacccaccacuggcaccgcuccggcagcaccaucggcaaggcguucgaggccaccgugcgcggggccaagcggauggccguccugggcgacacggccugggacuucgggagcgugggcggggugcucaacucccugggcaagggcauccaccagaucuucggggcggccuucaagagccuguucggcgggauguccugguucagccagauccugaucggcacccuccugauguggcuggggcucaacaccaagaacggcuccaucagccugaugugccuggcccucggcgggguccugaucuuccuguccaccgccgugagcgcggacgugggcugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5651 - RNA, 2524 nt, Artificial Sequence
  KU744693.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggccauggcccaggacaagcccaccguggacaucgagcuggugaccaccacggucagcaacauggcggaggugcgcuccuacugcuacgaggccagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgcgugcuccaagaagaugaccggcaagagcauccagcccgagaaccuggaguaccgcaucaugcuguccgugcacggcagccagcacuccgggaugcucgucaacgacaccggccacgagaccgacgagaaccgcgccaagguggagaucacgccgaacagcccccgggccgaggccacccucgggggcuucgggucccugggccuggacugcgagccccgcaccggccuggacuucagcgaccuguacuaccucaccaugaacaacaagcacuggcuggcccacaaggagugguuccacgacaucccccugccguggcacgcgggggccgccacgggcacgccccacuggaacaacaaggaggcccucgucgaguucaaggacgcgcacgccaagcggcagaccguggugguccuggggucccaggagggcgccgugcacaccgcccuggccggggcgcucgaggccgagauggacggcgccaagggccgccugagcuccgggcaccugaagugccggcucaagauggacaagcugcgccugaagggcgugagcuacucccucugcaccgccgccuucaccuucaccaagauccccgcggagaccgucgacgggaccgugacgguggagggccaguacggcgggaccgacggccccugcaaggucccggcccagauggccguggacaugcagacccugacccccguggggcggcugaucacggccaaccccgucaucaccgagagcaccgagaacuccaagaugaugcucgagcuggacccgcccuucggcgacagcuacaucgugaucggggugggcgagaagaagaucacccaccacuggcaccgcuccggcagcacgaucgggaaggccuucgaggcgaccguccggggcgccaagcgcauggccgugcugggggacaccgccugggacuucggcagcgucgggggcgcgcucaacucccugggcaaggggauccaccagaucaucggcgccgccuucaagagccuguucgggggcauguccugguucagccagauccugaucgggacccuccugauguggcugggccucaacacgaagaacggcuccaucagccugaugugccuggcccucgggggcgugcugaucuuccuguccaccgccgugagcgggggcguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5652 - RNA, 2524 nt, Artificial Sequence
  KY328290.1 prME-long mRNA Design 2 GC
ggggcgcugccuacggagguggcagccaucuccuucucggcaucaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucuccaagauccccgccgagacccuccacgggaccgugacggaggagguccaguacgccggcaccgacggccccugcaaggugccggcccagauggccguggacaugcagacccugacccccgucgggcggcugaucacggcgaaccccgugaucaccgagagcaccgagaacuccaagaugaugcucgagcuggacccgcccuucggcgacagcuacaucgugaucggggucggcgagaagaagaucacccaccacuggcaccgcagcggguccacgaucggcaaggccuucgaggccaccgugcggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagccugaugugccuggcgcucggcggcgugcugaucuuccuguccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5653 - RNA, 2524 nt, Artificial Sequence
  KX694532.2 prME-long mRNA Design 2 GC
ggggcgcugccuacggagguggcagccaucuccuucucggcaucaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggacggugaccgucgaggugcaguacgccggcaccgacggccccugcaaggugccggcccagauggccgucgacaugcagacccugacgcccguggggcggcugaucaccgcgaaccccgugaucaccgaguccaccgagaacagcaagaugaugcucgagcuggacccgcccuucggcgacuccuacaucgucaucggggugggcgagaagaagaucacgcaccacuggcaccgcagcgggagcaccaucggcaaggccuucgaggccaccgugcggggcgccaagcgcauggccguccugggggacaccgcgugggacuucggcuccgucgggggcgcccucaacagccuggggaagggcauccaccagaucuucggcgccgccuucaagucccuguucgggggcaugagcugguucucccagauccugaucgggacgcuccugauguggcugggccucaacaccaagaacgggagcaucucccugaugugccuggcgcucggcggcgugcugaucuuccugagcaccgccguguccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5654 - RNA, 2524 nt, Artificial Sequence
  KU955593.1 prME-long mRNA Design 2 GC
ggggcgcugccuacggagguggcagccaucuccuucucggcaucaagcuuaccaugcgcaucaucaacgcccggaaggagaagaagcgccggggcaccgacaccagcguggggaucgucggccugcuccugacgaccgccauggcgguggaggugacccgccgggggaacgccuacuacauguaccuggaccgcuccgacgccggcgaggccaucagcuuccccaccacgauggggaugaacaagugcuacauccagaucauggaccucggccacaugugcgacgccaccauguccuacgagugcccgaugcuggacgagggcgucgagcccgacgacguggacugcuggugcaacaccaccagcacguggguggucuacgggaccugccaccacaagaagggcgaggcgcggcgcucccggcgcgccgugacccugcccagccacuccacccggaagcuccagacgcgcagccagaccuggcuggagucccgggaguacaccaagcaccugauccgcguggagaacuggaucuuccggaaccccggguucgcccucgccgcggccgccaucgccuggcugcugggcagcuccaccagccagaaggucaucuaccucgugaugauccugcugaucgccccggcguacuccauccgcugcaucggggugagcaaccgggacuucgucgagggcauguccggcgggacguggguggacgugguccucgagcacggcgggugcgugaccgugauggcccaggacaagcccaccgucgacaucgagcuggugaccacgaccgugagcaacauggccgagguccgcuccuacugcuacgaggccagcaucuccgacauggccagcgacagccggugccccacccagggcgaggcguaccuggacaagcaguccgacacccaguacgugugcaagcgcacgcucguggaccggggcugggggaacggcugcgggcuguucggcaaggggagccuggugaccugcgccaaguucgccugcuccaagaagaugaccggcaagagcauccagcccgagaaccucgaguaccgcaucaugcuguccgugcacggcagccagcacuccgggaugaucgucaacgacaccggccacgagacggacgagaaccgcgccaagguggagaucaccccgaacagcccccgggccgaggcgacccucgggggcuucgggucccugggccuggacugcgagccccgcaccggccuggacuucagcgaccucuacuaccugacgaugaacaacaagcacuggcuggugcacaaggagugguuccacgacaucccccucccguggcacgccggggccgacaccggcacgccccacuggaacaacaaggaggcccuggucgaguucaaggacgcccacgcgaagcggcagaccguggugguccuggggucccaggagggcgccgugcacaccgcccucgccggggcgcuggaggccgagauggacggcgccaagggccgccugagcuccgggcaccucaagugccggcugaagauggacaagcugcgccucaagggcgugagcuacucccugugcaccgccgccuucaccuucaccaagauccccgcggagacccugcacgggacggucaccguggaggugcaguacgccggcaccgacggccccugcaaggucccggcccagauggccguggacaugcagacccucacgcccguggggcggcugaucaccgccaaccccgucaucaccgagagcaccgagaacuccaagaugaugcuggagcucgacccgcccuucggcgacagcuacaucgugaucggggugggcgagaagaagaucacgcaccacuggcaccgcuccgggagcaccaucggcaaggcguucgaggccaccguccggggcgccaagcgcauggccgugcugggggacaccgccugggacuucggcagcgucgggggcgcgcugaacucccucgggaagggcauccaccagaucuucggcgccgccuucaagagccuguucgggggcauguccugguucagccagauccugaucgggacgcugcucgucuggcugggccugaacaccaagaacggguccaucagccucaugugccuggcccugggcggcgugcucaucuuccuguccaccgcggugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5655 - RNA, 2524 nt, Artificial Sequence
  KY272987.1 prME-long mRNA Design 2 GC
ggggcgcugccuacggagguggcagccaucuccuucucggcaucaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggacggugaccgucgaggugcaguacgccggcaccgacggccccugcaaggugccggcccagauggccgucgacaugcagacccugacgcccguggggcggcugaucaccgcgaaccccgugaucaccgaguccaccgagaacagcaagaugaugcucgagcuggacccgcccuucggcgacuccuacaucgucaucggggugggcgagaagaagaucacgcaccacuggcaccgcagcgggagcaccaucggcaaggccuucgaggccaccgugcggggcgccaagcgcauggccguccugggggacaccgcgugggacuucggcuccgucgggggcgcccucaacagccuggggaagggcauccaccagaucuucggcgccgccuucaagucccuguucgggggcaugagcugguucucccagauccugaucgggacgcuccugauguggcugggccucaacaccaagaacgggagcaucucccuggugugccuggcgcucggcggcgugcugaucuuccugagcaccgccguguccgccgacguggggugcagcgucgacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5656 - RNA, 2524 nt, Artificial Sequence
  EU545988.1 prME-long mRNA Design 2 GC
ggggcgcugccuacggagguggcagccaucuccuucucggcaucaagcuuaccaugcgcaucaucaacgcccggaaggagaagaagcgccggggcaccgacaccagcguggggaucgucggccugcuccugacgaccgccauggcgguggaggugacccgccggggguccgccuacuacauguaccuggaccgcagcgacgccggcgaggccaucuccuuccccaccacgcucgggaugaacaagugcuacauccagaucauggaccugggccacaugugcgacgccaccaugagcuacgagugcccgaugcuggacgagggcgucgagcccgacgacguggacugcuggugcaacaccaccuccacguggguggucuacgggaccugccaccacaagaagggcgaggcgcggcgcagccggcgcgccgugacccuccccucccacagcacccggaagcugcagacgcgcucccagaccuggcuggagagccgggaguacaccaagcaccucauccgcguggagaacuggaucuuccggaaccccggguucgcccuggccgcggccgccaucgccuggcugcucggcuccagcaccucccagaaggucaucuaccuggugaugauccugcucaucgccccggcguacagcauccgcugcaucgggguguccaaccgggacuucgucgagggcaugagcggcgggacguggguggacgugguccuggagcacggcgggugcgugaccgugauggcccaggacaagcccgccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucgccugcagcaagaagaugaccggcaaguccauccagcccgagaaccuggaguaccgcaucaugcugagcgugcacggcucccagcacagcgggaugaucgucaacgacaccggccacgagaccgacgagaaccgcgccaagguggagaucacgccgaacagcccccgggcggaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcccuggucgaguucaaggacgcgcacgccaagcggcagaccguggugguccucgggagccaggagggcgccgugcacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgaguccaccgagaacagcaagaugaugcucgagcuggacccgcccuucggcgacuccuacaucgugaucggggugggcgagaagaagaucacccaccacuggcaccgcagcgggagcacgaucggcaaggccuucgaggccaccguccggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcgcucggcggcgugcugaucuuccugagcaccgccguguccgccgacgucgggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5657 - RNA, 2524 nt, Artificial Sequence
  KU681082.3 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcgaggccaucuccuuccccaccacccucgggaugaacaagugcuacauccagaucauggaccugggccacaugugcgacgcgacgaugagcuacgagugcccgaugcuggacgagggcgucgagcccgacgacguggacugcuggugcaacaccaccuccaccuggguggucuacgggacgugccaccacaagaagggcgaggcccggcgcagccggcgcgccgugacccuccccucccacagcacccggaagcugcagacccgcucccagacguggcuggagagccgggaguacaccaagcaccucauccgcguggagaacuggaucuuccggaaccccggguucgcccuggcggccgccgucaucgccuggcugcucggcuccagcaccucccagaaggugaucuaccuggugaugauccugcucaucgccccggcguacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggccagcgacucccggugccccacccagggcgaggcguaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggagaucacgccgaacagcccccgggccgaggcgacccucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcccugguggaguucaaggacgcccacgcgaagcggcagaccguggucgugcucgggagccaggagggcgccgugcacaccgcccuggccggggcgcuggaggccgagauggacggcgccaagggccgccucuccagcgggcaccugaagugccggcugaagauggacaagcuccgccugaagggcgucuccuacagccugugcaccgccgccuucaccuucaccaagauccccgcggagacccuccacgggaccgugacgguggagguccaguacgccggcaccgacggccccugcaaggugccggcccagauggccguggacaugcagacccugacccccgucgggcggcugaucacggccaaccccgugaucaccgaguccaccgagaacagcaagaugaugcucgagcuggacccgcccuucggcgacuccuacaucgugaucggggucggcgagaagaagaucacccaccacuggcaccgcagcgggagcacgaucggcaaggcguucgaggccaccgugcggggcgccaagcgcauggccgugcugggggacaccgccugggacuucggcuccgucgggggcgcgcucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcccucggcggcgugcugaucuuccugagcaccgcggucuccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5658 - RNA, 2524 nt, Artificial Sequence
  KX601167.1 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcgaggccaucuccuuccccaccacccucggggucaacaagugcuacauccagaucauggaccugggccacaugugcgacgcgacgaugagcuacgagugcccgaugcuggacgagggcguggagcccgacgacguggacugcuggugcaacaccaccuccaccugggucguguacgggacgugccaccacaagaagggcgaggcccggcgcagccggcgcgccgugacccuccccucccacagcacccggaagcugcagacccgcucccagacguggcuggagagccgggaguacaccaagcaccucauccgcgucgagaacuggaucuuccggaaccccggguucgcccuggcggccgccgccaucgccuggcugcucggcuccagcaccucccagaaggugaucuaccuggugaugauccugcucaucgcgccggccuacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggagaucacgccgaacagcccccgggcggaggccacccucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcccugguggaguucaaggacgcgcacgccaagcggcagaccguggucgugcucgggagccaggagggcgccgugcacaccgcccuggcgggggcccuggaggccgagauggacggcgccaagggccgccucuccagcgggcaccugaagugccggcugaagauggacaagcuccgccugaagggcgucuccuacagccugugcaccgccgcguucaccuucaccaagauccccgccgagacccuccacgggaccgugacgguggagguccaguacgccggcaccgacggccccugcaaggugccggcccagauggccguggacaugcagacccugacccccgucgggcggcugaucacggcgaaccccgugaucaccgaguccaccgagaacagcaagaugaugcucgagcuggacccgcccuucggcgacuccuacaucgugaucggggucggcgacaagaagaucacccaccacugguaccgcagcgggagcacgaucggcaaggccuucgaggccaccgugcggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcgcucggcggcgugcugaucuuccugagcaccgccgucuccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5659 - RNA, 2524 nt, Artificial Sequence
  KX694533.2 prME-long mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcaaggccaucuccuuccccaccacccucggggucaacaagugcuacauccagaucauggaccugggccacaugugcgacgcgacgaugagcuacgagugcccgaugcuggacgagggcguggagcccgacgacguggacugcuggugcaacaccaccuccaccugggucguguacgggacgugccaccacaagaagggcgaggcccggcgcagccggcgcgccgugacccuccccucccacagcacccggaagcugcagacccgcucccagacguggcuggagagccgggaguacaccaagcaccucauccgcgucgagaacuggaucuuccggaaccccggguucgcccuggcggccgccgccaucgccuggcugcucggcuccagcaccucccagaaggugaucuaccuggugaugauccugcucaucgcgccggccuacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaucggccacgagaccgacgagaaccgcgccaagguggagaucaccccgaacagcccccgggcggaggccacgcucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacaccggcacgccccacuggaacaacaaggaggcccugguggaguucaaggacgcgcacgccaagcggcagaccguggucgugcucgggagccaggagggcgccgugcacaccgcccuggcgggggcccuggaggccgagauggacggcgccaagggccgccucuccagcgggcaccugaagugccggcugaagauggacaagcuccgccugaagggcgucuccuacagccugugcaccgccgcguucacguucaccaagauccccgccgagacccuccacgggaccgugaccguggagguccaguacgccggcacggacggccccugcaaggugccggcccagauggccguggacaugcagacccugacccccgucgggcggcugaucaccgcgaaccccgugaucacggaguccaccgagaacagcaagaugaugcucgagcuggacccgcccuucggcgacuccuacaucgugaucggggucggcgacaagaagaucacccaccacuggcaccgcagcgggagcaccaucggcaaggccuucgaggccacggugcggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacaccaagaacgggagcaucucccugacgugccuggcgcucggcggcgugcugaucuuccugagcaccgccgucuccgccgacguggggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5660 - RNA, 2524 nt, Artificial Sequence
  KY288905.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucacccugguggccgucgccaucgccuggcugcucggcuccagcaccucccagaaggugaucuaccuggugaugauccugcucaucgcccccgcguacagcauccgcugcaucggggucuccaaccgggacuucguggagggcaugagcggcgggacguggguggacgucgugcuggagcacggcgggugcgugaccgucauggcccaggacaagccgaccguggacaucgagcuggugaccacgaccgucuccaacauggccgaggugcgcagcuacugcuacgaggccuccaucagcgacauggccagcgacucccggugccccacccagggcgaggcguaccucgacaagcagagcgacacccaguacgugugcaagcgcacgcuggucgaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggaggucacccccaacuccccgcgggccgaggccacccucgggggcuucgggagccugggccuggacugcgagccccgcacgggccucgacuucuccgaccuguacuaccugaccaugaacaacaagcacuggcucgugcacaaggagugguuccacgacaucccccugcccuggcacgcgggggccgacaccggcaccccgcacuggaacaacaaggaggcccugguggaguucaaggacgcccacgccaagcggcagacggucguggugcucgggagccaggagggcgcgguccacaccgcccuggccggggcccuggaggcggagauggacggcgccaagggccgccucuucuccgggcaccugaagugccggcugaagauggacaagcuccgccugaagggcgugagcuacucccugugcaccgccgccuucaccuucaccaaggugcccgccgagacgcuccacgggaccgucaccguggaggugcaguacgcgggcaccgacggccccugcaagguccccgcccagauggccguggacaugcagacgcugaccccgguggggcggcugaucaccgccaaccccgucaucaccgagagcacggagaacuccaagaugaugcucgagcuggacccgcccuucggcgacagcuacaucgugaucggggugggcgacaagaagaucacccaccacuggcaccgcuccgggagcaccaucggcaaggccuucgaggcgaccguccggggcgccaagcgcauggccgugcugggggacacggccugggacuucggcagcgucgggggcguguucaacucccucgggaagggcauccaccagaucuucggcgccgcguucaagagccuguucgggggcauguccugguucagccagauccugaucgggacccugcucguguggcugggccugaacaccaagaacggguccaucagccugaccugccucgcccugggcggcgugaugaucuuccucuccacggccgucagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5661 - RNA, 2524 nt, Artificial Sequence
  KF268950.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaaccucggggugaacaagugccacguccagaucauggaccugggccacaugugcgacgccaccaugagcuacgagugccccaugcuggacgagggcguggagcccgacgacguggacugcuggugcaacacgaccuccaccugggucguguacgggaccugccaccacaagaagggcgaggcccgccggagccgccgggcggugacgcuccccucccacagcacccgcaagcugcagacccggucccagaccuggcuggagagccgcgaguacacgaagcaccucaucaaggucgagaacuggaucuuccggaaccccggguucgcccuggccgccguggccaucgcguggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagccgacgguggacaucgagcuggucaccaccaccguguccaacauggccgaggugcgcagcuacugcuacgaggcguccaucagcgacauggccagcgacucccggugccccacgcagggcgaggccuaccucgacaagcagagcgacacccaguacgucugcaagcgcacccugguggaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacaucggccacgagaccgacgagaaccgcgccaaggucgaggugacccccaacuccccgcgggcggaggccacgcucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacaccggcacgccgcacuggaacaacaaggaggcccuggucgaguucaaggacgcgcacgccaagcggcagaccguggugguccucgggagccaggagggcgccgugcacaccgcccuggcgggggcccuggaggccgagauggacggcgccaagggccgccucuucuccgggcaccugaagugccggcugaagauggacaagcuccgccugaagggcgugagcuacucccugugcaccgccgcguucacguucaccaagguccccgccgagacccuccacgggaccgugaccguggagguccaguacgccggcacggacggccccugcaaggugcccgcccagauggccguggacaugcagacccugaccccggucgggcggcugaucaccgcgaaccccgugaucacggagagcaccgagaacuccaagaugaugcucgagcuggacccgcccuucggcgacagcuacaucgugaucggggucggcgacaagaagaucacccaccacuggcaccgcuccgggagcaccaucggcaaggccuucgaggccacggugcggggcgccaagcgcauggccgugcugggggacaccgcgugggacuucggcagcgucgggggcguguucaacucccucgggaagggcgugcaccagaucuucggcgccgccuucaagagccuguucgggggcauguccugguucagccagauccugaucgggacccugcucgucuggcugggccugaacaccaagaacggguccaucagccucacgugccuggcccugggcggcgugaugaucuuccucuccaccgcggugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5662 - RNA, 2524 nt, Artificial Sequence
  KF383121.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaucggccacgagaccgacgagaaccgcgccaagguggaggugacccccaacuccccgcgggccgaggcgacccucgggggcuucgggagccugggccuggacugcgagccccgcaccggccucgacuucuccgaccuguacuaccugaccaugaacaacaagcacuggcucguccacaaggagugguuccacgacaucccccugcccuggcacgccggggccgacacgggcaccccgcacuggaacaacaaggaggcccugguggaguucaaggacgcccacgcgaagcggcagaccguggucgugcucgggagccaggagggcgccgugcacaccgcccuggccggggcgcuggaggccgagauggacggcgccaagggccgccucuucuccgggcaccugaagugccggcugaagauggacaagcuccgccugaagggcgucagcuacucccugugcacggccgccuucaccuucaccaaggugcccgcggagacccuccacgggaccgugacggucgaggugcaguacgccggcaccgacggccccugcaaggugcccgcccagauggccgucgacaugcagacccugaccccgguggggcggcugaucacggccaaccccgugaucaccgagagcaccgagaacuccaagaugaugcucgagcuggacccgcccuucggcgacagcuacaucgucaucggggugggcgacaagaagaucacccaccacuggcaccgcuccgggagcacgaucggcaaggcguucgaggccaccgugcggggcgccaagcgcauggccguccugggggacaccgccugggacuucggcagcgucgggggcguguucaacucccucgggaagggcauccaccagaucuucggcgcggccuucaagagccuguucgggggcauguccugguucagccagauccugaucgggacccugcucguguggcugggccugaacacgaagaacggguccaucagccugaccugccucgcccugggcggcgugaugaucuuccucuccaccgccgugagcgcggacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5663 - RNA, 2506 nt, Artificial Sequence
  KF268949.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaaccucggggugaacaagugccacguccagaucauggaccugggccacaugugcgacgccaccaugagcuacgagugccccaugcuggacgagggcguggagcccgacgacguggacugcuggugcaacacgaccuccaccugggucguguacgggaccugccaccacaagaagggcgaggcccgccggagccgccgggcggugacgcuccccucccacagcacccgcaagcugcagacccggucccagaccuggcuggagagccgcgaguacacgaagcaccucaucaaggucgagaacuggaucuuccggaaccccggguucgcccuggccgccguggccaucgcguggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagccgacgguggacaucgagcuggucaccaccaccguguccaacauggccgaggugcgcagcuacugcuacgaggcguccaucagcgacauggccagcgacucccggugccccacgcagggcgaggccuaccucgacaagcagagcgacacccaguacgucugcaagcgcacccugguggaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacgagaaccgcgccaaggucgaggugacccccaacuccccgcgggcggaggccacccucggcggguucggcagccuggggcuggacugcgagccccgcacgggccucgacuucuccgaccuguacuaccugaccaugaacaacaagcacuggcucgugcacaaggagugguuccacgacaucccccugcccuggcacgccggcgccgacaccgggaccccgcacuggaacaacaaggaggcccuggucgaguucaaggacgcgcacgccaagcggcagacgguggugguccucggcagccaggagggggccgugcacaccgcccuggcgggcgcccuggaggccgagauggacggggccaagggccgccucuucuccggccaccugaagugccggcugaagauggacaagcuccgccugaagggggugagcuacucccugugcaccgccgcguucaccuucacgaagguccccgccgagacccuccacggcaccgugaccguggagguccaguacgccgggaccgacggccccugcaaggugcccgcccagauggccguggacaugcagacgcugaccccggucggccggcugaucaccgcgaaccccgugaucaccgagagcacggagaacuccaagaugaugcucgagcuggacccgcccuucggggacagcuacaucgugaucggcgucggggacaagaagaucacccaccacuggcaccgcuccggcagcaccaucgggaaggccuucgaggccaccgugcggggcgccaagcgcauggccgugcugggcgacacggcgugggacuucgggagcgucggcgggguguucaacucccucggcaaggggauccaccagaucuucggcgccgccuucaagagccuguucggcgggauguccugguucagccagauccugaucggcacccugcucguguggcuggggcugaacaccaagaacggcuccaucagccugaccugccuggcccucgggggcgucaugaucuuccucuccacggcggugagcgccgacgugggcugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5664 - RNA, 2524 nt, Artificial Sequence
  KU955595.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggaggucacccccaacuccccgcgggccgaggcgacccucgggggcuucgggagccugggccuggacugcgagccccgcaccggccucgacuucuccgaccuguacuaccugacgaugaacaacaagcacuggcucgugcacaaggagugguuccacgacaucccccugcccuggcacgccggggccgacaccggcaccccgcacuggaacaacaaggaggcccugguggaguucaaggacgcccacgcgaagcggcagaccgucguggugcucgggagccaggagggcgccguccacacggcccuggccggggcgcuggaggccgagauggacggcgccaagggccgccucuucuccgggcaccugaagugccggcugaagauggacaagcuccgccugaagggcgugagcuacucccugugcaccgccgccuucaccuucaccaaggugcccgcggagacccuccacgggacggucaccguggaggugcaguacgccggcaccgacggccccugcaagguccccgcccagauggccguggacaugcagacccugacgccgguggggcggcugaucaccgccaaccccgucaucaccgagagcaccgagaacuccaagaugaugcucgagcuggacccgcccuucggcgacagcuacaucgugaucggggugggcgacaagaagaucacgcaccacuggcaccgcuccgggagcaccaucggcaaggcguucgaggccaccguccggggcgccaagcgcauggccgugcugggggacaccgccugggacuucggcagcgucgggggcguguucaacucccucgggaagggcauccaccagaucuucggcgcggccuucaagagccuguucgggggcauguccugguucagccagauccugaucgggacgcugcucguguggcugggccugaacaccaagaacggguccaucagccugaccugccucgcccugggcggcgugaugaucuuccucuccaccgccgucagcgcggacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5665 - RNA, 2524 nt, Artificial Sequence
  KF383116.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccagcacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacaucggccacgagaccgacgagaaccgcgccaagguggaggucacccccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccugguggaguucaaggacgcccacgcgaagcggcagaccgucguggugcucgggagccaggagggcgccguccacaccgcccuggccggggcgcuggaggccgagauggacggcgccaagggccgccucuucuccgggcaccugaagugccggcugaagauggacaagcuccgccugaagggcgugagcuacucccugugcacggccgugugcaccgccgcgaagguccccgccgagacccuccacgggaccgugaccguggagguccaguacgccggcacggacggccccugcaaggugcccgcccagauggccguggacaugcagacccugaccccggucgggcggcugaucaccgcgaaccccgugaucacggagagcaccgagaacuccaagaugaugcucgagcuggacccgcccuucggcgacagcuacaucgugaucggggucggcgacaagaagaucacccaccacuggcaccgcuccgggagcaccaucggcaaggccuucgaggccacggugcggggcgccaagcgcauggccgugcugggggacaccgcgugggacuucggcagcgucgggggcguguucaacucccucgggaagggcauccaccagaucuucggcgccgccuucaagagccuguucgggggcauguccugguucagccagauccugaucgggacccugcucguguggcugggccugaacaccaagaacggguccaucagccucacgugccuggcccugggcggcgucaugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5666 - RNA, 2506 nt, Artificial Sequence
  KU963574.2 prME-long mRNA Design 2 GC
ggggcgcugccuacggagguggcagccaucuccuucucggcaucaagcuuaccaugcgcaucaucaacgcccggaaggagcgcaagcggcgcggcgccgacgcgagcaucgggaucgugucccugcuccugaccaccgucauggccgccgagaucacgcggcgcggcagcgccuacuacauguaccuggaccgguccgacgccgggaaggcgaucagcuucgugaccacccucggcgugaacaagugccacguccagaucauggaccuggggcacaugugcgacgccaccauguccuacgagugccccaugcuggacgagggcguggagcccgacgacguggacugcuggugcaacacgaccagcaccugggucguguacgggaccugccaccacaagaagggggaggcccgccggucccgccgggccgugacgcuccccagccacuccacccgcaagcugcagacccggagccagaccuggcuggagucccgcgaguacacgaagcaccucaucaaggucgagaacuggaucuuccggaaccccggcuucgcgcugguggccguggccaucgccuggcugcucgggagcuccaccagccagaaggucaucuaccuggugaugauccugcucaucgcccccgcguacuccauccgcugcaucggcgugagcaaccgggacuucgucgaggggauguccggcggcaccuggguggacgugguccuggagcacgggggcugcgugaccgugauggcccaggacaagccgacggucgacaucgagcuggugaccaccaccgugagcaacauggccgagguccgcuccuacugcuacgaggccagcaucagcgacauggccuccgacagccggugccccacgcagggggaggcguaccucgacaagcaguccgacacccaguacgugugcaagcgcacccuggucgaccggggcuggggcaacgggugcggccuguucgggaagggcagccucgugaccugcgccaaguucacgugcuccaagaagaugaccggcaagagcauccagcccgagaaccuggaguaccgcaucaugcuguccgugcacggcagccagcacuccggcaugaucgucaacgacgagaaccgcgccaagguggaggugacccccaacagcccgcgggccgaggccacccucgggggcuucgggucccugggccuggacugcgagccccgcacggggcucgacuucagcgaccuguacuaccugaccaugaacaacaagcacuggcucguccacaaggagugguuccacgacaucccccugcccuggcacuccggcgcggacaccgagaccccgcacuggaacaacaaggaggcccugguggaguucaaggacgcccacgccaagcggcagacgguggucgugcucggcagccaggagggggccgugcacaccgcgcuggccggcgcccuggaggccgagauggacggggcgaagggccgccucuccagcgggcaccugaagugccggcugaagauggacaagcuccgccugaagggcgucuccuacagccugugcaccgccgccuucaccuucacgaaggugcccgccgagacccuccacggcaccgugaccgucgaggugcaguacgccgggcgggacggccccugcaaggugcccgcgcagauggccgucgacaugcagacccugacgccgguggggcgccugaucaccgccaaccccgugaucaccgaguccaccgagaacagcaagaugaugcucgagcuggacccgcccuucggcgacagcuacaucgucaucggcgugggggacaagaagaucacgcaccacuggcaccgguccggcagcaucaucgggaaggccuucgaggccaccgugcgcggcgcgaagcggauggccguccugggggacaccgccugggacuucggcuccgugggcgggguguucaacagccucggcaaggggauccaccagaucuucggcgccgccuucaagucccuguucgggggcaugagcugguucucccagauccugaucggcacccugcucgucuggcuggggcugaacacgaagaacggcagcaucucccugaccugccuggcgcucgggggcgugaugaucuuccucagcaccgccguguccgccgacgucgggugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5667 - RNA, 2506 nt, Artificial Sequence
  KX601166.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacgagaaccgcgccaagguggaggucacccccaacuccccgcgggccgaggcgacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgccgacaccgggacgccgcacuggaacaacaaggaggcccugguggaguucaaggacgcccacgcgaagcggcagaccgucguggugcucggcagccaggagggggccguccacaccgcccuggccggcgcgcuggaggccgagauggacggggccaagggccgccucuucuccggccaccugaagugccggcugaagauggacaagcuccgccugaagggggugagcuacucccugugcaccgccgccuucacguucaccaaggugcccgcggagacccuccacggcaccgucaccguggaggugcaguacgccgggacggacggccccugcaagguccccgcccagauggccguggacaugcagacccugaccccggugggccggcugaucaccgccaaccccgucaucacggagagcaccgagaacuccaagaugaugcucgagcuggacccgcccuucggggacagcuacaucgugaucggcgugggggacaagaagaucacccaccacuggcaccgcuccggcagcaccaucgggaaggcguucgaggccacgguccggggcgccaagcgcauggccgugcugggcgacaccgccugggacuucgggagcgugggcggggucuucaacucccucggcaaggggauccaccagaucuucggcgcggccuucaagagccuguucggcgggauguccugguucagccagauccugaucggcacccugcucguguggcuggggcugaacaccaagaacggcuccaucagccucacgugccuggcccucgggggcgugaugaucuuccuguccaccgccgucagcgcggacgugggcugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5668 - RNA, 2524 nt, Artificial Sequence
  KF383118.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagccggacgacguggacugcuggugcaacaccaccuccaccugggucguguacgggacgugccaccacaagaagggcgagacccgccggagccgccgguccgugagccuccgcuaccacuacacccggaagcugcagacccgcucccagacguggcuggagagccgggaguacaagaagcaccucaucauggucgagaacuggaucuuccgcaaccccggguucgccaucguguccguggcgaucaccuggcugaugggcagccugaccucccagaaggucaucuaccucgugaugaucgugcugaucguccccgccuacagcaucuccugcaucggggugagcaaccgggaccugguggagggcauguccggcgggaccugggucgacguggugcucgagcacggcgggugcgucacggagauggcccaggacaagcccaccguggacaucgagcuggugaccaugaccgucagcaacauggccgaggugcgcuccuacugcuacgaggccagccugagcgacauggcguccgccagccggugcccgacgcagggcgagcccucccucgacaagcagagcgacacccaguccgugugcaagcgcacccugggcgaccggggguggggcaacgggugcggcaucuucgggaagggcagccuggugaccugcuccaaguucacgugcugcaagaagaugcccggcaagagcauccagcccgagaaccucgaguaccgcaucaugcugccgguccacgggucccagcacagcggcaugaucgucaacgacaucgggcacgagaccgacgagaaccgcgccaagguggaggugacccccaacagcccccgggccgaggccacccugggcggguucggcucccucggccuggacugcgagccccgcacggggcuggacuucuccgaccucuacuaccugaccaugaacaacaagcacuggcugguccacaaggagugguuccacgacaucccgcuccccuggcacgcgggcgccgacaccgggacgccccacuggaacaacaaggaggcccugguggaguucaaggacgcccacgccaagcggcagaccguggucgugcugggcagccaggagggggcggugcacaccgcccucgccggcgcccuggaggccgagauggacggcgcgaaggggcgccuguucuccggccaccucaagugccggcugaagauggacaagcugcgccucaagggggucagcuacucccugugcaccgccgccuucaccuucacgaaggugcccgccgagacccugcacggcaccgugaccgucgaggugcagagcgcgggcaccgacgggccgugcaaggugcccgcccagauggccgucgacaugcagacgcucacccccgugggccggcugaucaccgccaaccccgugaucaccgaguccacggagaacagcaagaugaugcuggagcucgacccgcccuucggggacagcuacaucgucaucggcgugggggacaagaagaucacccaccacuggcaccgcuccggcagcaccaucggcaaggccuucgaggcgaccgugcgcggggccaagcggauggccguccugggcgacacggccugggacuucggguccgugggcgggguguucaacagccugggcaagggcauccaccagaucuucggggccgcguucaagucccucuucggcgggaugagcugguucucccagauccugaucggcacccugcuggucuggcucgggcugaacaccaagaacggcagcaucucccugaccugccucgcccugggcggggugaugaucuuccugagcacggccguguccgccgacgucggcugcagcguggacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5669 - RNA, 2518 nt, Artificial Sequence
  KF383120.1 prME-long mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaccaugggggugaacaagugccacguccagaucauggaccucggccacaugugcgacgccacgaugagcuacgagugccccaugcuggacgagggcguggagccggacgacguggacugcuggugcaacaccaccuccaccugggucguguacgggacgugccaccacaagaagggcgaggcccgccccagccggcgcgcggugacccugcccucccacagcacccggaagcuccagacccgcucccagacguggcuggagagccgggaguacaccaagcaccugaucaaggucgagaacuggauccuccgcaaccccggguucaccguggccgcccuggccauggccuggcugcucggcaacuccaccagccagcgggugaucuaccuggucaugauccugcucaucgcgccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggccagcaucuccgacauggcgagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucacgugcuccaagaagaugaccggcaagagcauccagcccgagaaccuggaguaccgcaucaugcuguccguccacggcagccagcacuccgggaugaucgugaacgacaucggccacgagaccgacgagaaccgcgccaaggucgaggugaccccgaacagcccccgggccgaggcgacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcacgccccacuggaacaacaaggaggcccuggucgaguucaaggacgcccacgcgaagcggcagaccguggugguccucgggucccaggagggcgccgugcacaccgcccuggccggggcgcuggaggccgagauggacggcgccaagggccgccucuucagcgggcaccugaagugccggaucaagauggacaagcugcgccucaagggcguguccuacagccugugcaccgccgccuucaccuucuccaagguccccgcggagacccugcacgggaccgugacgguggagguccaguacgccggccgggacggccccugcaaggugccggcccagauggccguggacaugcagacccucacccccgucgggcgccugaucaccgccaaccccaucaucacggagagcaccgagaacucccggaugaugcuggagcucgacccgcccuucggcgacagcuacaucgugaucggggugggcgacaagaagaucacccaccacuggcaccgcuccgggagcaccaucggcaaggcguucgaggccacgguccggggcgccaagcgcauggccgugcugggggacaccgccugggacuucggcagcgucgggggcguguucaacucccuggggaagggcgugcaccagguguucggcgcggccuucaagagccucuucgggggcauguccugguucagccagauccugaucgggacccugcuggucuggcucggccugaacaccaagaacggguccaucagccuggccugccucgcccugggcggcgcgaugaucuuccuguccacggccgugagcgccgacguggggugcuccgucgacuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5670 - RNA, 2449 nt, Artificial Sequence; identical to SEQ ID NO: 5505
  KU321639.1 prME-short mRNA Design 2 GC

SEQ ID NO: 5671 - RNA, 2449 nt, Artificial Sequence; identical to SEQ ID NO: 5506
  KU312312.1 prME-short mRNA Design 2 GC

SEQ ID NO: 5672 - RNA, 2437 nt, Artificial Sequence; identical to SEQ ID NO: 5507
  AY632535.2 prME-short mRNA Design 2 GC

SEQ ID NO: 5673 - RNA, 2449 nt, Artificial Sequence; identical to SEQ ID NO: 5508
  KU527068.1 prME-short mRNA Design 2 GC

SEQ ID NO: 5674 - RNA, 2449 nt, Artificial Sequence
  KX421193.1 prME-short mRNA Design 2 GC
ggggcgcugccuacggagguggcagccaucuccuucucggcaucaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucgucaacgacaccggguacgagaccgacgagaaccgcgccaagguggaggugacccccaacuccccgcgggccgaggccacccucggcggguucggcagccuggggcuggacugcgagccccgcaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcggcagaccguggucgugcucggcagccaggagggggccgugcacacggcgcuggccggcgcccuggaggccgagauggacggggcgaagggcaagcuguucuccggccaccugaagugccgccugaagauggacaagcuccgccugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccggcugaucaccgccaaccccgugaucaccgagagcaccgagaacuccaagaugaugcucgagcuggacccgcccuucggggacagcuacaucgucaucggcgugggggacaagaagaucacgcaccacuggcaccgcuccggcagcaccaucgggaaggccuucgaggccaccgugcggggcgccaagcgcauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5675 - RNA, 2449 nt, Artificial Sequence
  KX377335.1 prME-short mRNA Design 2 GC
ggggcgcugccuacggagguggcagccaucuccuucucggcaucaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccggaagaagggggaggcccgccggagccgccgggccgugacccuccccucccacagcacccgcaagcugcagacccggucccagacguggcuggagagccgcgaguacaccaagcaccucaucaaggucgagaacuggaucuuccggaaccccggcuucgcccugguggcgguggccaucgccuggcugcucggguccagcaccucccagaaggucaucuaccuggugaugauccugcucaucgcccccgccuacagcauccgcugcaucggcguguccaaccgggacuucgucgaggggaugagcggcggcaccuggguggacgugguccuggagcacgggggcugcgugacggugauggcgcaggacaagccgaccgucgacaucgagcuggugaccaccacgguguccaacauggccgagguccgcagcuacugcuacgaggccuccaucagcgacauggccagcgacucccggugccccacccagggggaggccuaccucgacaagcagagcgacacccaguacgugugcaagcgcacccugguggaccggggcuggggcaacgggugcggccuguucgggaagggcucccucgucacgugcgcgaaguucacgugcagcaagaagaugaccgggaaguccauccagcccgagaaccuggaguaccgcaucaugcugagcgugcacggcucccagcacagcggcaugaucgucaacgacaccggguacgagaccgacgagaaccgggccaagguggaggugacccccaacuccccgcgcgccgaggccacccucggcggguucggcagccuggggcuggacugcgagccccggaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcgccagaccguggucgugcucggcagccaggagggggccgugcacacggcgcuggccggcgcccuggaggccgagauggacggggcgaagggcaagcuguucuccggccaccugaagugccgccugaagauggacaagcuccggcugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccgccugaucaccgccaaccccgugaucaccgagagcaccgagaacuccaagaugaugcucgagcuggacccgcccuucggggacagcuacaucgucaucggcgugggggacaagaagaucacgcaccacuggcaccgguccggcagcaccaucgggaaggccuucgaggccaccgugcgcggcgccaagcggauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5676 - RNA, 2449 nt, Artificial Sequence
  LC002520.1 prME-short mRNA Design 2 GC
ggggcgcugccuacggagguggcagccaucuccuucucggcaucaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaccgucaacgacaucggguacgagaccgacgagaaccgcgccaagguggaggugacccccaacuccccgcgggccgaggccacccucggcggguucggcagccuggggcuggacugcgagccccgcaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcggcagaccguggucgugcucggcagccaggagggggccgugcacacggcgcuggccggcgcccuggaggccgagauggacggggcgaagggcaagcuguucuccggccaccugaagugccgccugaagauggacaagcuccgccugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccggcugaucaccgccaaccccgugaucaccgagagcaccgagaacuccaagaugaugcucgagcuggacccgcccuucggggacagcuacaucgucaucggcgugggggacaagaagaucacgcaccacuggcaccgcuccggcagcaccaucgggaaggccuucgaggccaccgugcggggcgccaagcgcauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5677 - RNA, 2431 nt, Artificial Sequence
  DQ859059.1 prME-short mRNA Design 2 GC
ggggcgcugccuacggagguggcagccaucuccuucucggcaucaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucacccugguggccgucgcgaucgccuggcugcucggguccagcaccucccagaaggugaucuaccuggugaugauccugcucaucgcccccgccuacagcauccggugcaucggcgucuccaaccgcgacuucguggaggggaugagcggcggcacguggguggacgucgugcuggagcacgggggcugcgugaccgucauggcccaggacaagccgaccguggacaucgagcuggugaccacgaccgucuccaacauggcggaggugcggagcuacugcuacgaggccuccaucagcgacauggccagcgacucccgcugccccacccagggggaggccuaccucgacaagcagagcgacacccaguacgugugcaagcggacgcuggucgaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacgagaaccgcgcgaagguggaggucacccccaacuccccgcgggccgaggccacccucgggggcuucgggagccugggccuggacugcgagccccgcaccgggcucgacuucuccgaccuguacuaccugaccaugaacaacaagcacuggcucgugcacaaggagugguuccacgacaucccccugcccuggcacgccggcgccgacacgggcaccccgcacuggaacaacaaggaggcgcugguggaguucaaggacgcccacgccaagcggcagaccgucguggugcucgggagccaggagggcgccguccacaccgcccuggcgggggcccuggaggccgagauggacggcgccaaggggcgccucuucuccggccaccugaagugccgccugaagauggacaagcuccggcugaagggcgugagcuacucccugugcacggcggccuucaccuucaccaaggugcccgccgagacccuccacgggaccgucacgguggaggugcaguacgccggcaccgacgggcccugcaagguccccgcccagauggcgguggacaugcagacccugaccccggugggccgccugaucacggccaaccccgucaucaccgagagcaccgagaacuccaagaugaugcucgagcuggacccgcccuucggcgacagcuacaucgugaucggggugggcgacaagaagaucacccaccacuggcaccgguccgggagcacgaucggcaaggccuucgaggccaccguccgcggggccaagcggauggcggugcugggcgacaccgccugggacuucggcagcgucgggggcguguucaacucccucgggaagggcauccaccagaucuucggggccgccuucaagagccuguucggcggcauguccugguucagccagauccugaucgggacccugcucguguggcugggccugaacacgaagaacggguccaucagccugaccugccucgcccugggcggggugaugaucuuccucuccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5678 - RNA, 2437 nt, Artificial Sequence
  KU963573.2 prME-short mRNA Design 2 GC
ggggcgcugccuacggagguggcagccaucuccuucucggcaucaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucggguacgagaccgacgagaaccgcgccaaggucgaggugacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgcggacacggggaccccgcacuggaacaacaaggaggcccuggucgaguucaaggacgcccacgccaagcggcagaccguggugguccucggcagccaggagggggccgugcacaccgcgcuggccggcgcccuggaggccgagauggacggggcgaagggcaagcuguucuccggccaccugaagugccgccugaagauggacaagcuccgccugaagggggugagcuacucccugugcacggccgccuucaccuucaccaagguccccgccgagacccuccacggcaccgugacgguggagguccaguacgccgggaccgacggccccugcaagauccccgugcagauggcgguggacaugcagacccugaccccggucggccggcugaucacggccaaccccgugaucaccgagagcaccgagaacuccaagaugaugcucgagcuggacccgcccuucggggacagcuacaucgugaucggcgucggggacaagaagaucacccaccacuggcaccgcuccggcagcacgaucgggaaggccuucgaggccaccgugcggggcgccaagcgcauggcggugcugggcgacaccgccugggacuucgggagcgucggcgggguguucaacucccucggcaaggggauccaccagaucuucggcgccgccuucaagagccuguucggcgggauguccugguucagccagauccugaucggcacccugcucguguggcuggggcugaacacgaagaacggcuccaucagccugaccugccucgcccucgggggcgucaugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5679 - RNA, 2449 nt, Artificial Sequence
  KX694534.2 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggccgggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5680 - RNA, 2449 nt, Artificial Sequence
  KX369547.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggccuggcccuggccgcggccgccaucgccuggcuccuggggagcuccaccagccagaaggugaucuaccuggucaugauccuccugaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5681 - RNA, 2449 nt, Artificial Sequence
  KX447515.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacugguaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5682 - RNA, 2449 nt, Artificial Sequence
  KU729218.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacacccagacccugacgcccgugggccggcugaucaccgccaaccccgugaucaccgagagcaccgagaacuccaagaugaugcucgagcuggacccgcccuucggggacagcuacaucgucaucggcgugggggagaagaagaucacgcaccacuggcaccgcuccggcagcaccaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacgcuccugauguggcuggggcucaacaccaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5683 - RNA, 2449 nt, Artificial Sequence
  KU501217.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgagauccgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcucccuggggcuggacugcgagccccggaccggccucgacuucagcgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcucccaggagggggccgugcacaccgcccuggccggcgcgcuggaggccgagauggacggggccaagggccgccucagcuccggccaccugaagugccggcugaagauggacaagcuccgccugaagggggucagcuacucccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5684 - RNA, 2449 nt, Artificial Sequence
  KU312314.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugccccaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugcuggcccagauggccgucgacaugcagacccugaccccggugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5685 - RNA, 2449 nt, Artificial Sequence
  KX446950.2 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgacccuggacgagggcguggagcccgacgacgucgacugcuggugcaacaccaccagcacgugggugguguacgggaccugccaccacaagaagggggaggcgcggcgcucccggcgcgccgucacccuccccagccacuccacccggaagcugcagacgcgcagccagaccuggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcacgugggucgacguggugcuggagcacgggggcugcgucaccgugauggcccaggacaagcccaccguggacaucgagcuggucaccacgaccgugagcaacauggccgaggugcgcuccuacugcuacgaggccagcaucuccgacauggccagcgacagccggugccccacccagggggaggcguaccucgacaagcaguccgacacccaguacgucugcaagcgcacgcugguggaccggggcuggggcaacgggugcggccuguucgggaagggcagccucgugaccugcgccaaguucgccugcuccaagaagaugaccggcaagagcauccagcccgagaaccuggaguaccgcaucaugcuguccguccacggcagccagcacuccggcaugaucgugaacgacaccgggcacgagacggacgagaaccgggccaaggucgagaucaccccgaacagcccccgcgccgaggcgacccucggcggguucggcucccuggggcuggacugcgagccccggaccggccucgacuucagcgaccuguacuaccugacgaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcacggugaccgucgaggugcaguacgccgggaccgacggccccugcaaggugccggcccagauggccgucgacaugcagacccugacgcccgugggccggcugaucaccgccaaccccgugaucaccgagagcaccgagaacuccaagaugaugcucgagcuggacccgcccuucggggacagcuacaucgucaucggcgugggggagaagaagaucacgcaccacuggcaccgcuccggcagcaccaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacgcuccugauguggcuggggcucaacaccaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5686 - RNA, 2449 nt, Artificial Sequence
  KY003157.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgucgugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5687 - RNA, 2449 nt, Artificial Sequence
  KX811222.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcgcgugggugguguacgggaccugccaccacaagaagggcgaggcccggcgcucccggcgcgccgucacgcuccccagccacuccacccggaagcugcagacccgcccccagaccuggcuggagagccgggaguacacgaagcaccucauccgcguggagaacuggaucuuccggaacccgggcuucgcccuggcggccgccgccaucgccuggcugcucggguccagcaccucccagaaggugaucuaccuggucaugauccugcucaucgcgcccgccuacagcauccgcugcaucggcguguccaaccgggacuucguggaggggaugagcggcggcaccugggucgacguggugcuggagcacgggggcugcgucaccgugauggcccaggacaagcccacgguggacaucgagcuggucaccaccaccguguccaacauggccgaggugcgcagcuacugcuacgaggccuccaucagcgacauggcguccgacagccggugccccacgcagggggaggccuaccucgacaagcagagcgacacccaguacgucugcaagcgcacccugguggaccggggcuggggcaacgggugcggccuguucgggaagggcucccucgugaccugcgccaaguucgccugcagcaagaagaugacggggaaguccauccagccggagaaccuggaguaccgcaucaugcugagcguccacggcucccagcacagcggcaugaucgugaacgacaccgggcacgagaccgacgagaaccgggccaaggucgagaucacccccaacagcccccgcgcggaggccacgcucggcggguucggcucccuggggcuggacugcgagccccggaccggccucgacuucuccgaccuguacuaccugaccaugaacaacaagcacuggcucgugcacaaggagugguuccacgacaucccgcugcccuggcacgccggcgccgacaccgggacgccccacuggaacaacaaggaggcccugguggaguucaaggacgcgcacgccaagcgccagaccgucguggugcucggcagccaggagggggccguccacaccgcccuggcgggcgcccuggaggccgagauggacggggccaagggccgccucuccagcggccaccugaagugccggcugaagauggacaagcuccgccugaaggggguguccuacagccugugcaccgccgcguucacguucaccaagauccccgccgagacccuccacggcaccgugaccgucgaggugcaguacgccgggacggacggcccgugcaaggugcccgcccagauggccgucgacaugcagacccugacccccgugggccggcugaucaccgcgaaccccgugaucacggaguccaccgagaacagcaagaugaugcucgagcuggacccgcccuucggggacuccuacaucgucaucggcgugggggagaagaagaucacccaccacuggcaccgcagcggcuccaccaucgggaaggccuucgaggccacggugcggggcgccaagcgcauggccguccugggcgacaccgcgugggacuucgggagcgugggcggggcccucaacagccugggcaaggggauccaccagaucuucggcgccgccuucaagucccuguucggcgggaugagcugguucucccagauccugaucggcacccuccugauguggcuggggcucaacaccaagaacggcagcaucucccugaugugccuggcgcucgggggcgugcugaucuuccugagcacggccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5688 - RNA, 2449 nt, Artificial Sequence
  KX447516.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagcaagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5689 - RNA, 2449 nt, Artificial Sequence
  KX520666.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccacccgccagaaggugaucuaccuggucaugauccugcucaucgccccggcguacagcauccggugcaucggcguguccaaccgcgacuucguggaggggaugagcggcggcaccugggucgacguggugcuggagcacgggggcugcgucacggugauggcccaggacaagcccaccguggacaucgagcuggucaccaccacgguguccaacauggccgaggugcggagcuacugcuacgaggccuccaucagcgacauggccuccgacagccgcugccccacccagggggaggcguaccucgacaagcagagcgacacccaguacgucugcaagcggacccugguggaccgcggcuggggcaacgggugcggccuguucgggaagggcucccucgugacgugcgccaaguucgccugcagcaagaagaugaccgggaaguccauccagcccgagaaccuggaguaccggaucaugcugagcguccacggcucccagcacagcggcaugaucgugaacgacaccgggcacgagaccgacgagaaccgcgccaaggucgagaucacgccgaacagcccccgggccgaggcgacccucggcggguucggcucccuggggcuggacugcgagccccgcaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccggcucuccagcggccaccugaagugccgccugaagauggacaagcuccggcugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgaguccaccgagaacagcaagaugaugcucgagcuggacccgcccuucggggacuccuacaucgucaucggcgugggggagaagaagaucacccaccacuggcaccggagcggcuccacgaucgggaaggcguucgaggccaccgugcgcggcgccaagcggauggccguccugggcgacaccgccugggacuucgggagcgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcggucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5690 - RNA, 2449 nt, Artificial Sequence
  KU497555.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcacccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcacggugaccgucgaggugcaguacgccgggaccgacggccccugcaaggugccggcccagauggccgucgacaugcagacccugacgcccgugggccggcugaucaccgccaaccccgugaucaccgaguccaccgagaacagcaagaugaugcucgagcuggacccgcccuucggggacuccuacaucgucaucggcgugggggagaagaagaucacgcaccacuggcaccgcagcggcuccaccaucgggaaggcguucgaggccaccgugcggggcgccaagcgcauggccguccugggcgacaccgccugggacuucgggagcgugggcggggcgcucaacagccugggcaaggggauccaccagaucuucggcgccgccuucaagucccuguucggcgggaugagcugguucucccagauccugaucggcacgcuccugauguggcuggggcucaacaccaagaacggcagcaucucccugaugugccuggcccucgggggcgugcugaucuuccugagcaccgcggucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5691 - RNA, 2449 nt, Artificial Sequence
  KY075939.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacucccugcgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5692 - RNA, 2449 nt, Artificial Sequence
  KY075932.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcaucgagaacuggaucuuccggaaccccggcuucgcccuggccgcggccgccaucgccuggcugcucgggagcuccaccagccagaaggugaucuaccuggugaugauccugcucaucgccccggcguacuccauccgcugcaucggcgucagcaaccgggacuucguggaggggauguccggcggcaccuggguggacgucgugcuggagcacgggggcugcgugacggucauggcccaggacaagcccaccguggacaucgagcuggugaccaccacggucagcaacauggccgaggugcgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcucccuggggcuggacugcgagccccggaccggccucgacuucagcgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcucccaggagggggccgugcacaccgcccuggccggcgcgcuggaggccgagauggacggggccaagggccgccucagcuccggccaccugaagugccggcugaagauggacaagcuccgccugaagggggucagcuacucccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5693 - RNA, 2449 nt, Artificial Sequence
  KU870645.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggauccugcggaaccccggcuucgcccuggccgcggccgccaucgccuggcuccuggggagcuccaccagccagaaggugaucuaccuggucaugauccuccugaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcaucggggagaagaagaucacccaccacuggcaccgcuccggcagcacgaucgggaaggcguucgaggccaccgugcggggcgccaagcgcauggccgugcucggcgacaccgccugggacuucgggagcgucggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5694 - RNA, 2449 nt, Artificial Sequence
  KU729217.2 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucagcaccaccguguccaacauggccgaggugcgcagcuacugcuacgaggccacgaucuccgacaucgccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgccgucgugcucggcucccaggagggggccgugcacaccgcccuggcgggcgcccuggaggccgagauggacggggccaagggccgccucagcuccggccaccugaagugccggcugaagauggacaagcuccgccugaagggggucagcuacucccugugcaccgccgcguucaccuucaccaagauccccgccgagacccuccacggcaccgugacgguggagguccaguacgccgggaccgacggccccugcaaggugccggcccagauggccguggacaugcagacccugacccccgucggccggcugaucacggcgaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggccuucgaggccaccgugcggggcgccaagcgcauggccgugcugggcgacaccgcgugggacuucgggagcgucggcggggcccucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcgcucgggggcgugcugaucuuccuguccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5695 - RNA, 2449 nt, Artificial Sequence
  KX087101.3 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgagcugcaguacgccgggaccgacggccccugcaaggugccggcccagauggccguggacaugcagacccugacccccgucggccggcucaucacggccaaccccgugaucaccgagagcaccgagaacuccaagaugaugcuggagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcucggcgacaccgccugggacuucgggagcgucggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5696 - RNA, 2449 nt, Artificial Sequence
  KY014317.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaucgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5697 - RNA, 2449 nt, Artificial Sequence
  KU758876.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggugaagggccgccucagcuccggccaccugaagugccggcugaagauggacaagcuccgccugaagggggugagcuacucccugugcaccgccgccuucaccuucaccaagauccccgccgagacccuccacggcaccgucacgguggaggugcaguacgcggggaccgacggccccugcaaggucccggcccagauggccguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccucaacucccugggcaaggggauccaccagaucuucggcgcggccuucaagagccuguucggcgggauguccugguucagccagauccugaucggcacccuccugauguggcuggggcucaacacgaagaacggcuccaucagcuucaugugccuggcccucgggggcguccugaucuuccuguccaccgccgugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5698 - RNA, 2449 nt, Artificial Sequence
  KU758874.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggcaagcucagcuccggccaccugaagugccgccugaagauggacaagcuccggcugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgagagcaccgagaacuccaagaugaugcucgagcuggacccgcccuucggggacagcuacaucgucaucggcgugggggagaagaagaucacccaccacuggcaccgguccggcagcacgaucgggaaggcguucgaggccaccgugcgcggcgccaagcggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5699 - RNA, 2449 nt, Artificial Sequence
  KY317939.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaaggacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5700 - RNA, 2449 nt, Artificial Sequence
  KY014314.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggaggcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5701 - RNA, 2449 nt, Artificial Sequence
  KX447517.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcggcccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcgcacgccaagcgccagaccgucguggugcucggcucccaggagggggccguccacaccgcccuggcgggcgcccuggaggccgagauggacggggccaagggccgccucagcuccggccaccugaagugccggcugaagauggacaagcuccgccugaagggggugagcuacucccugugcaccgccgcguucacguucaccaagauccccgccgagacccuccacggcaccgugaccgucgaggugcaguacgccgggacggacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagacccugaucggcacccuccugauguggcuggggcucaacacgaagaacggcuccaucagccugaugugccuggcgcucgggggcgugcugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5702 - RNA, 2449 nt, Artificial Sequence
  KU926310.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccggggccgacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcgcucgggggcgugcugaucuuccuguccacggccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5703 - RNA, 2449 nt, Artificial Sequence
  KU922923.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugccccaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgcccuggcguacuccauccgcugcaucggcgugagcaaccgggacuucguggaggggauguccggcggcaccugggucgacguggugcuggagcacgggggcugcgucacggugauggcccaggacaagccgaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgcccaacagcccgcgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugcccuggcacgccggcgccgacacggggaccccgcacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcacggccgccuucaccuucaccaagauccccgcggagacccugcacggcaccgugacggucgaggugcaguacgccgggaccgacggccccugcaaggugcccgcccagauggccgucgacaugcagacccugaccccggugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5704 - RNA, 2449 nt, Artificial Sequence
  KY075937.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggucagcgacagccggugccccacccagggggaggccuaccucgacaagcaguccgacacccaguacgugugcaagcgcacccugguggaccggggcuggggcaacgggugcggccuguucgggaagggcagccucgucacgugcgcgaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggccacccucggcggguucggcucccuggggcuggacugcgagccccggaccggccucgacuucagcgaccuguacuaccugaccaugaacaacaagcacuggcucgugcacaaggagugguuccacgacaucccccugccguggcacgcgggcgccgacacggggacgccccacuggaacaacaaggaggcccuggucgaguucaaggacgcccacgccaagcgccagaccguggugguccucggcucccaggagggggcggugcacaccgcccuggccggcgcccuggaggcggagauggacggggccaagggccgccucagcuccggccaccugaagugccggcugaagauggacaagcuccgccugaagggggugagcuacucccugugcaccgccgccuucaccuucaccaagauccccgccgagacccuccacggcaccgucacgguggaggugcaguacgcggggaccgacggccccugcaaggucccggcccagauggccguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccucaacucccugggcaaggggauccaccagaucuucggcgcggccuucaagagccuguucggcgggauguccugguucagccagauccugaucggcacccuccugauguggcuggggcucaacacgaagaacggcuccaucagccugaugugccuggcccucgggggcguccugaucuuccuguccaccgccgugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5705 - RNA, 2449 nt, Artificial Sequence
  KY003156.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcaucagcaaccgggacuucguggaggggauguccggcggcaccuggguggacgucgugcuggagcacgggggcugcgugacggucauggcccaggacaagcccaccguggacaucgagcuggugaccaccacggucagcaacauggccgaggugcgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcauccuggggcuggacugcgagccccggaccggccucgacuucuccgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcagccaggagggggccgugcacaccgcccuggccggcgcgcuggaggccgagauggacggggccaagggccgccucuccagcggccaccugaagugccggcugaagauggacaagcuccgccugaagggggucuccuacagccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggagaagaagaucacccaccacuggcaccgcagcggcuccacgaucgggaaggcguucgaggccaccgugcggggcgccaagcgcauggccgugcugggcgacaccgccugggacuucgggagcgucggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcgguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5706 - RNA, 2449 nt, Artificial Sequence
  KU312313.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacacgugcgacgccaccauguccuacgagugcccgaugcuggacgagggcguggagcccgacgacgucgacugcuggugcaacaccaccagcacgugggugguguacgggaccugccaccacaagaagggggaggcgcggcgcucccggcgcgccgucacccuccccagccacuccauccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacggcagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacgccaagaacggcuccaucagccugaugugccuggcgcucgggggcgugcugaucuuccuguccacggccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5707 - RNA, 2449 nt, Artificial Sequence
  KY075935.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcagcggucccgccgggccgucacccuccccagccacuccacccgcaagcugcagacccggagccagacguggcuggagucccgcgaguacaccaagcaccucauccggguggagaacuggaucuuccgcaaccccggcuucgcccuggccgcggccgccaucgccuggcugcucgggagcuccaccagccagaaggugaucuaccuggucaugauccugcucaucgccccggcguacuccauccggugcaucggcgugagcaaccgcgacuucguggaggggauguccggcggcaccugggucgacguggugcuggagcacgggggcugcgucacggugauggcccaggacaagcccaccguggacaucgagcuggucaccaccacggugagcaacauggccgaggugcgguccuacugcuacgaggccagcaucuccgacauggccagcgacagccgcugccccacccagggggaggcguaccucgacaagcaguccgacacccaguacgucugcaagcggacccugguggaccgcggcuggggcaacgggugcggccuguucgggaagggcagccucgugacgugcgccaaguucgccugcuccaagaagaugaccggcaagagcauccagcccgagaaccuggaguaccggaucaugcuguccguccacgggagccagcacuccggcaugaucgugaacgacaccgggcacgagaccgacgagaaccgcgccaaggucgagaucacgccgaacagcccccgggccgaggcgacccucggcggguucggcucccuggggcuggacugcgagccccgcaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcggcagaccgucguggugcucggcucccaggagggggccguccacaccgcccuggccggcgcgcuggaggccgagauggacggggccaagggccgccucagcuccggccaccugaagugccgccugaagauggacaagcuccggcugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgagagcaccgagaacuccaagaugaugcucgagcuggacccgcccuucggggacagcuacaucgucaucggcgugggggagaagaagaucacccaccacuggcaccgguccggcagcacgaucgggaaggcguucgaggccaccgugcgcggcgccaagcggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5708 - RNA, 2449 nt, Artificial Sequence
  KY014320.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcaggcccgcagccagaccuggcuggagucccgggaguacacgaagcaccucauccgcguggagaacuggaucuuccggaaccccggcuucgcccuggcggccgccgccaucgccuggcugcucgggagcuccaccagccagaaggugaucuaccuggucaugauccugcucaucgcgccggccuacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggcgagcgacagccggugccccacgcagggggaggccuaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacgggagccagcacuccggcaugaucgugaacgacaccgggcacgagaccgacgagaaccgggccaaggucgagaucaccccgaacagcccccgcgcggaggccacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcgcacgccaagcgccagaccgucguggugcucggcucccaggagggggccguccacaccgcccuggcgggcgcccuggaggccgagauggacggggccaagggccgccucagcuccggccaccugaagugccggcugaagauggacaagcuccgccugaagggggugagcuacucccugugcaccgccgcguucacguucaccaagauccccgccgagacccuccacggcaccgugaccgucgaggugcaguacgccgggacggacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcgcucgggggcgugcugaucuuccuguccacggccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5709 - RNA, 2449 nt, Artificial Sequence
  KY328290.1 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucuccaagauccccgcggagacccuccacggcaccgugaccgaggagguccaguacgccgggacggacggccccugcaaggugccggcccagauggccguggacaugcagacccugacccccgucggccggcugaucaccgccaaccccgugaucacggagagcaccgagaacuccaagaugaugcucgagcuggacccgcccuucggggacagcuacaucgugaucggcgucggggagaagaagaucacccaccacuggcaccgcagcggcuccaccaucgggaaggcguucgaggccacggugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5710 - RNA, 2449 nt, Artificial Sequence
  KU681081.3 prME-short mRNA Design 2 GC
ggggcgcugccuacggagguggcagccaucuccuucucggcaucaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacacgggcgccgacaccgggacgccccacuggaacaacaaggaggcccugguggaguucaaggacgcccacgccaagcgccagaccgucguggugcucggcagccaggagggggcgguccacaccgcccuggccggcgcccuggaggcggagauggacggggccaagggccgccucuccagcggccaccugaagugccggcugaagauggacaagcuccgccugaaggggguguccuacagccugugcaccgccgccuucaccuucaccaagauccccgccgagacccuccacggcacggugaccgucgaggugcaguacgcggggaccgacggccccugcaaggugccggcccagauggccgucgacaugcagacccugacgcccgugggccggcugaucaccgccaaccccgugaucaccgaggggaccgagaacuccaagaugaugcucgagcuggacccgcccuucggcgacagcuacaucgucaucggggugggcgagaagaagaucacgcaccacuggcaccgcuccgggagcaccaucggcaaggccuucgaggcgaccgugcggggcgccaagcgcauggccguccugggggacaccgccugggacuucggcagcgucgggggcgugcucaacucccuggggaagggcauccaccagaucuucggcgccgcguucaagagccuguucgggggcauguccugguucagccagauccugaucgggacgcuccugauguggcugggccucaacaccaagaacggguccaucagccugaugugccuggcccucggcggcgugcugaucuuccuguccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
